United States Patent 12,642,819 (COMPOSITIONS AND METHODS FOR TREATING INFLAMMATORY BOWEL DISEASE) - sequence listing, part 17

SEQ ID NO: 7 - DNA, 6690361 bp, Bacteroides ovatus (residues 3,345,183-5,017,773 of 6,690,361)
  modified_base (929456)..(929464): a, c, t, g, unknown or other
  modified_base (962678)..(962772): a, c, t, g, unknown or other
  modified_base (2590973)..(2591071): a, c, t, g, unknown or other
  modified_base (3187898)..(3187995): a, c, t, g, unknown or other
  modified_base (6474561)..(6474747): a, c, t, g, unknown or other
  modified_base (6477672)..(6477709): a, c, t, g, unknown or other
  modified_base (6478509)..(6478549): a, c, t, g, unknown or other
  modified_base (6488706)..(6488754): a, c, t, g, unknown or other
  modified_base (6648431)..(6648490): a, c, t, g, unknown or other
  modified_base (6654630)..(6654722): a, c, t, g, unknown or other
  modified_base (6657753)..(6657797): a, c, t, g, unknown or other
  modified_base (6660696)..(6660710): a, c, t, g, unknown or other
  modified_base (6674308)..(6674332): a, c, t, g, unknown or other
  modified_base (6681249)..(6681294): a, c, t, g, unknown or other
  modified_base (6683446)..(6683468): a, c, t, g, unknown or other
  modified_base (6684775)..(6684788): a, c, t, g, unknown or other
cgtgattggcagaaaggtggaatcagctacgaagcaccagcaagtttctggggaaaggcagatttctgggctcctgatctttactattatgaaggtaaatattatatgtttgctacttttagtggaacagatggaatacggggagcatctgtattgatatctgataaaccggaaggtccatttattccattagttaaccggccgattacccctaatggatggcaagcattagatgccgcacttttcgttgatgagaataaagatccgtggattgtatttagccatgaatggacacaaatatcagacggaactattgttgcacagaaattaacaaaagatttgaaagaagcggctgaagaaccggtaaccttatttgcggcgagtgaagcaccttgggttataagaaattcatattatgtatcagatgctccatttttatatagggcaaataatggtgaacttttgatgctttggtctagttttttgttgggaaaagatgggaatggacaatatgccattggggtggcacgttctcaatcgggtactattttgggaccttggctacaagatccacagccattgaatccgaatgacaatggagggcatgctatgatttttagggattttgatggggttctgcgtatctcgtatcactctcctaatactccggggggaagtgagaggcttacaatacatagaattgttgataatgacggacaattatctattgattttacctcggcattaagtaactaaacttgatataatatgaagtacataattctatatggaatgtgtgtaatagcgcagatgttattattcacagggtgtgaagataaagaacaggtttcttcttatttggcattggataaagatgaacaaagtcagtcgtttacggctgcggcaagtacaaaagagataactctgttttctaatttgggagttattgctgatatatctcctgtggaagcaacagcttggtgtcggtttagtttaaaaagtgtgacagaagctgaatcggttctgattattagtgtagatgaaaatacggtaaagaaagggagaaaagcgatcataactctcactgcccctgattatcggaatgtaaaagtcaatattacccaatctggcatcattttacccatcaaattaacagagtttgaaccacataatggagggaagggtgatatagtgacactcaaaggtgaaaattttggagatatagcagctaatttacatgtttcttttggaaatactgttgcagagattctttcggcaagtgatacggaactacaggttaaggttcctaaaattacgaataatcaaccttgtaaaataagtgtgaaattggataaaatggaggaagcttatactgataattttgtttatgagaagcgctggtggatagaaaatttgaaagtggatgtattaccttcagcaattgctgttgataatacaggaaagaacattctctttctacgtcgttttcccgatgatcggattccggcagaattgggactttatcgtttgtcggaaactggtgaagtatcttttctcgctggctatgatcgtgttgcgggagggtatggctttacgagtgttgtttatgataatgtttctaagaagttttacgcaatagctgaatgtggaggtacagctattcaactaattgtagttgacccagctaataactggtcgactgaggtgaaggctgtcgaagcgggtattgatggctattggggtgttggattgacagctagcaaagatggtaaattatatactcgtcaagggtggactaatacagttatagaaatagatccttcaacatggactgcaaagacaataggactagtggaacggcatggtaatcaggagttttcaactgcccttgctgttgcgaccggtacgaataatttgtatgtgcaaattagatcaacatctgagttagcgtatattgatgttgtgacaggcgaggttacttggttgaatacttctgttgaaacaggttattgggatggtatatttgctgaagctcgtttcttgagaggtgaacagatgtgctcggacgatgcaggcaatatctatattgtcgatcaggataatcatgcgattcgtatggtgaataatacaggagtttcgacagttattggggggaatggttctggcgctgttaatggtgttggcaaagatgcaaaattatgtgctccttcaggattatgtatggatgctaatggggttatgtatattggagacacatggaatgctagtattagaaaagccgtctttgagtagtctctctgattataaaattttgaaatattaattcgattatgaaaaagatattactctcattttttattggcattatgttaatagcctgcagtcagaaaacagtctctgttcgtgaagtctggacgaaagagcaggctaatgaatggtatcaacaatggggatggctccgtgggtgtgattttattccgagcacggcaatcaaccaattggagatgtggcaggctgatacttttgatccggttactattgatcgtgaactgggttgggcagaagatatcggaatgaactgtatgcgtgtatatttgcaccatttggtttgggaaacggataaggaaggttttaagaaacgtattaatgaataccttactattgccgacaagcatcatatctctaccatctttgtctttctggatgattgctggaatcctacttatcaggcaggaaaacaaccggaaccacaaccgggagtacataattcgggatgggcgcgtgatccgggagatttgtattataaaggtgatacggcagtgatacttccggtcttggagaattatgtgaaagatattcttaccacctttaaggatgataagagaattgtgttgtgggatttatataatgagcctggtggttcgggtggatatagatacggtgaaagaagtctgccgctattacaaaagatatttacgtggggacgaacagtaaacccgtcgcaacccttgtcagccggagtctgggatatgagtttgactaatttgaataagtttcagttggaaaactcggacgtgataacctatcacacgtatgaaggtctggattcgcatcaacagctcattgacacattgaagcaatatgggcgtccgatgatttgcacggaatatatggcacgtactcaaaatagtacttttcaggatattatgccgatgctgaagaaagaaaatattggtgcaataaactggggacttgtagccggaaagacaaatactatctttgcatgggatactccgttgcctgacgtagctgaaccgtccttgtggttccatgatattttccgtagcgatgggacaccttattcaacagaagaagtggaatgtattcgttcattaactaaataattcccttatgataactatgaggaatatatggataatgatgttggggatatgcttgtttggttgtggggctgctaaacagcccctttcctcacagctctctttaacatggaaactggaaaaagatagtgtggaagccagatattttaagaatacattctgtttgacgaataacgggaataaatccttggctgataattgggtgatctattttaatcagacaccaatttattatcagcaacctattaatgccccgttggaaatagaatgtattggttcgacttactataaaatgtatcctactgaacactatcaggcgttggcaccaggtgaaacactctcttttactatattgagtgaaggaaatgtgattaatgtatcttcggttcctgaaggggcttatattgtagctaccgatgaaaaagggaaaatgttgcagccgcaaaatattccgattgagatcggactgtttacgcccgatacccaatggattcgttcgaagaatagttttccctatgcagatggaaattatttgtataagcagaataatgatttcagcaagcctgtagattgtgatatgctttctctctttcctactcctaaaaaagtagagaagacgggtggcgtttctactttctctccaaaggtaggtctgaagtttgacggtgtatttaaagaagaagctcttttgttgaaaaagcaattggcttcacagttaggatgtaccgtttctgacaaggatgaagaaacaatcattgaattgaagaaaatggaggttcctattacctgtcaatatcccgatgaatattacgaaatcgtgataaagaataaccggttgactttgaaagctaatgatgcacatggcatatttaatgcttgtcaaacattgcttgccttattagataacatggaactaacttctgctccgctccccaatcttcatattaccgattatccggacatggggcatcggggaatcatgctggatgtagcccgtaattttacaaagaagacagacttactgaaactgatagatatactgtcattctataaaatgaatgtactgcacctgcatttgagtgatgatgaggcttggcgtgtggaaatacccggattggaagaattgacagaaatagcctctcgcagagggcatactacagatgaactgacatgtctttatcctgcttatgcttggggatggaatgaggcagataccacctcattggctaatgggtattattcccgcaatgactttatggatattttgaaatatgcaaaagaaaggcatatcagaattattcctgaaatagatattcccggccattcacgggcagcaataaaagccatgaatgcccgttaccggaaatatattgatacggatcagtcgaaagcggaagaatatcttctgattgactttgcagatacttcccaatatctatcggcacaaaatttcactgataatgttattaatgtcgcaatgctttctacataccgttttcttgaaaaagtgattgatgaaatcgggcggatgtatcaggatgcgggagtagaactacctgctttccatgtaggtggtgatgaagtgccggaaggcatttgggaaggttcttctgtctgccgtacttttatgaaaaaacatggactgactaagatacgggatttgaaagattattttctggggcaaattttggaaatgttggataaacgtaatatacaagcagttggatggcaagacatagttatgaatccggataataccgtgaacgaacatttcagaaatagcaaggtcttgaattattgctggaatacaattccggaacagggtggggatgaagttccgtataagttagcaaatgcgggctatcctattatactctgtaatgtgggtaatttctatttggatatggcctattgttatcatgtggaagaaccggggttacgttggggtggttacgtagatgagtacgtaacgtttgatatgttgccttttgatatttacaagtctttacggcggaatctgaaaggtgaatctgtggatgtaaaaacagcctcaaacggtaagcaacctttgacaaaagaggggtataagaatatcaaaggtttgtccggacaaatctgggcggagacaatccgtagtttcgaacaaatagaatattatcttttcccgaaagtctttggactggcagaacgcgtttggaatgctcaaccatcgtgggcattgtctccggacggcaaagtatatatggatgccaaacgaaaatataatgccggtattgtaacttatgaattgccccgtttggcaaaacgaggtattaatttccgggtatctcctccaggtattatagtaaaggatggattgttacttgttaatactaccaatcccaatgcggtaatccggtatacaaccgatggcagtgaacctacggaaagttctgtagaatggcaaacacagatagcatgtgatgctccactgataaaagcaaaggctttttatttaggaaaggaaagtgtaactaccgtattgataaacgaattatattaaatggtatgttaaaccctccagagaagaaattctttggagggttttcttattaattttgcttttaactcgaataattctctaaatttgtgccattaactcgactaatacatccatggagcatactgaaactttaatagtagagcagttgaagacaggtaacgaagatgcctatcaatacatctatgaccgtcactatgctctgctgtgtcatgtcgcgagcggctatgtaagagatcaattccttgcggaaaccattgtcggagataccatttttcatttatgggagattcgtgaaacgctggagatttccgtttccatccgtagctatttgttgagagccgtccgtaatcgttgtatcaactatcttaattcagaatgggaaaagcgcgagattgcgttttcatctctgatgcccgatgagataacagacgataaaatgacgatatccgattcgcatccgttggggacattgctggagcgtgaactggaagaggaaatatataaagccattgataaattgccgaacgaatgtcgtcgcgtgttcgataaaagccgttttgaaggaaaatcatacgaagaaatttctcaagagttaggcatctctgtcaatacggttaagtatcatataaagaatgcattagcatctttacaaacgaatctaagtaaatatctgattactctacttttattttttttcgggtaaaaacgaaaaaaagtcatttttagactaccctcaattaaaaatctactgtctcctttatagaacgcagaaaaatggaagaagaaaagaaacatattgatgaattgattgcaacctatctgaccgaaggtttggacaaaaatgctttagccgaactaaaagcatggatagctgcatcacctgaaaatgaggattattttattcagcaacgggaagtctggttctctgccgtgagccgtgaagccgcgtcgaaatacaataaagacaaggcattcgatacctttaagaatcgtatcgggagccggaagcaagtggagaaagctcctcgccaggaattccgtttgtcggcgttgtggcgttatgccgcgattatcgcagtcatacttgcagtaggatgcttctcatattggcagggaggagtgaatgtaaaagacacttttgcagatatatccgtagaggctcctttaggatcaagaacgaaactttatttgcctgatggtacattggtttggttgaatgccggttcacgaatgacctactcacaaggctttggagtagataaccgtaaagtagaattagaaggtgagggatattttgaagtccaacggaatgagaaactccctttctttgtaaagactaaagatttgcaattgcaggtattgggaacaaaatttaatttccgcgattatccggaagatcacgaagtggtagtatccttgttggaagggaaagtggaattaaataatttactgaaaaaagagaaagaagctttccttgcacccgacgagagagcgatattaaacaaagcgaacggattgatgaccgtagaaacggtcacagcctccaatgcctcccaatggacggatggctatctgttttttgatgaagaacttttgccggacatcgtgaaagaactggaacgtagctacaatgtgaatatccacatagctaatgattcattaaataaattccggttctacggaaacttcgtccgtcgggaacaaagtattcaggaagtgttggatgcgttggcatctacagagaaaatacaatataaaattgaagagcgcaatataactatctattaaccggttaccagagattataatactatgattgtttaaccttataattgaagaatatgagtaaaggaaataatactgaatagtctttagtgaatgataaggagagaaaaataaaaaccggaagatctcgaacatcttccggctcctgaatctcttcttcaacaactttcaaacgtgagcatgttttcaaaagagattatgcaaagttagcaaaatacatctcttttaaaacgagttattcaagttttaattaaataatttgtttattttatgaattacaggaagaaggccatattaatggtcgtggctctcttttgccttaacatagcaatactagcccaggccgtttcattgaaaatgaataatgtttcagtgaaagaagcaatgacgcaattgaagaataaaagcggatattctttcgtatataaagtgggagacctggatactaggaagattgtaagtgtaaaggcaaaacaattgaatgaagctatcgatcagatattgtacgggcaagaagttgtttatgaggtaaagggcaagaatattattgtccaaaaagggcaagcgcggcagaatacctctaaagacactaaaaagcgtaaagtcacaggtacagtgagcgatgccaacggtgaaccgatcatcggtgctaccatcaaggaaaaaggaacaaccaacggaaccgcatctgatttggatgctaagttctctctggaagtgtcaccgggagctgtattggaagtctcctatatcggttatcagacacaggaagtaaaggtgggcgaccgggtatctttatctgtcaccttggctgaaaatcagcaaatattggacgaggtggtagtggtggggtatggtacaacctcccgtaaaaacctgactacttctatcgctaccgtaaaaactgaaaaaatatccaaagcggctactagcaatatctcaggaatgttgctgggacgtgctgccggtttgcaggcaaccgttgccagtccccagccgggaggaggcatcaatatctccattcgtggaggtggtacaccgatttatgtggtggatggagtagttatgcctagcggctcttttgaagtcggcacgggaagtacgtcacttccttcttccgtcaatcgtgccggactggcaggattaaatcccaatgatattgaatctattgaaatcctgaaggatgcttctgcagcaatttatggtatcggagcagcggatggtgttattctggtgaccaccaaaaaaggaaaagagggaaaaccgaccatcgtgtatgaaggaagctattccgtgcaaaaacattatccttacctggatgtattgagcggacccgaactgatgaacatggtgaatgtgttcagtaaagagaattatttatatgacaaaggccagtatccttatggaaatgccgcttatgacgataaatggacacctatctttacaccgacacaaatagccaatgccccgactacggattggctggacaaggtactgaaaacaggtgcagtgaccaatcataatctgacgattagcggtggttcggaaaagtttaaatactatctgggcgttaactactataaagaagacgctaccgtttataattcggatatggagcgatactccctgcgtacaaacatcacatcccagctgactaatttcctgaaactgacaacaatagtcaacttgaatcagaataattacacgaactctactgtcggcggagatgtcggaaacttaagagatcagggagccggagcacttttcggagcaatcttctatccctcttatcttcccgtgtacgatgccgaaggacaatataatgtattcagccggacgcctaatcccgtttccatgcaagatattaatgacaaatccgagcaaaatggttactacatgaacttctcactggatgtcgatattatcaagaatatgctttcagccaaagtattgtatggcttgaacaaggaaaatacctctcgtgattcttacattccttctgatatttactacgcattgcaacgtaaatccagaggaaacttaggatatggaaaaaggcagcaaagcactctcgaaggtacattaacattccaacataaatttggagagttattggatatgaatttgatggccggtatgggacgttatcttgatagtggcgatggttcggatatatcttatgaaaatgccaatgaccatatacagggaagtagcgtaggtatggcagacggtcctttctatccgacttcctataaatataagaatgaaaagagatcacagtttgtcagaggaagtttcgacttattcggacgctatgtagtatccgcttcattgcgtcgtgacggtacggataaattctttcccagtaagaaatacgccttctttccatctgtttctcttgcatggaagatgaacgaagaatcatttataaagaatatctcctggattaatatgttgaaattaagagccagttacggtgaaacaggtagcgataacctgggtacaacactatacggtattgtaacgacaacccgcgaggatgttcaattcaataataattcggtaacttacattccctacatattgtccggcgctaactatgaagatgtcacctggcaaaagacagtcatgaaaaatatcggattggatttttctatttttagagatcgaatctggggtagtgtagatgtattccgtaacgacgtaacccatttgttgggaacagcgccgacagaattattgggaatgcacggaacacgtccaattaatggagggcattataaacgtaccggagtagatgtaagtctgaactcattgaatctccagacacatgattttaaatggacctctcaaattacgatgtcccattataacgcagtatggatagaacgtatgcctaactatgattatcagaaatatcagaaaaggaaaaatgaaccgatgaatgcattctattattataaaacgaccgatattatcgatgtggataagagtaatatgcccgaatcgcaacgttcattgggacctgccgcctgtatgccgggttatcctattgtcgaagataaaaacggtgatggaattattgacgtgaatgactcttacatggataacatgcttcctaaattatattttggttttggcaatacatttacatggaaaaactttgatctggatatatttatgtacggacaattaggtgtaaagaaatggaatgacgcatatagttatagtgcagatgccggaaatctctccagaggagtggatgcgcacaatgttggtatctattcttataacatctggaatacccagacaaacatgaacggacatttcccgggtatcgcaatcagtaaatcagtggctttacccgaaaatctgggctttgattatacaagagaaaatgcctcttatgtgcgtgtgagaaacatcacattgggatataacctgggtcccaaagaattatccatatttaaagggtatattagaggaatacgtgtgtttgtcgactttcagaatcctttgacctttaccaaatacaaaggatatgaccctgaaatcaacacttcttcttcgaatctgaccggaggacaatatcctcaaatgagagtttattcaataggtgcaaaattaaccttctaaacttcaagctatgaaatctaacaaattatgtcgtatgaaaaagaagttctttttaccgatgcttgtttccttgcaactcttattcggtagttgtgagaataattttgatccttatatttacggagctttgttacagggagaatatccttccacagagcaagagtatgtttcctatatgatggtttgctacctgccttatactacggtttggacgtatgatatgggttcgggtggtttgcaacatggtattcatatacagtctggaggagcggtgcgtatgtttgattctgcttctgatatatgtgcgcctgctaccacagtaggtgcagactgggaacgccttagtaaaggagattacagtaattgcttttattactggcgtggaaatgtagacgacggtggtaacttgaatcatttcccgaaaacagcccaggtgacccgtatgactgaagtgattggaacgttggaaaaagctcccctgactgctcttacggaagaaaagaagaataatttacttggagaagcacgtttgtgtcgtggattgatgatgtacttcctgttgcatgtttacggtcccgtaccggtaatcctggatcccgaaaaagtaattgatccggaagcgttgtcgaataccgtgcgcccttctttggatgaaatgactcaatggattacggatgatctggaatttgccgcaaagaatgctcccgaagtagccccggatttgggacgctatacgcgtgactatgcccgcttctgcctgatgaaacactgtctgaacgagggtgaacacatggaaggttattatcagagagcgattgatatgtataatgaactcaatacgggcaaatatgatttgtttaaaaccggaagtactccgtacgttgacctgttcaagaatgccaataaattcaataaagaaatgattatggctgtcagttgtagccctactgctgatggtaacccgaagcatggaaatgcgaatcctttcctgatgtgggctttaccttctgatgtggcaaaaggggatccttttccaatgggaggtggatggttccaggctttcagtatggataaaaaatactacgatgctttcgaaagcaacgacggtcgtctgaaaaccattgtaaccagttataaggacaagaatggtgtcgttatcaacaaagataatctgggggtgagatggaacggatatattataaataaattcccgcaggagacgatgactactttccagggtaccgatattcctttggcaagatgggccgatgtattattgatgtatgcagaggcagaagtgcgtaaaacaggaactgtaccttccgtagctgctataaatgcggtgaatcaggtgaggaaaagagccgggctgtcggacttgccgagtgtgacaaccaatacaaaagacgcttttttaaacgctattctgatagagcggggacatgaatttttctatgaaggtaatcgaaagattgacttgatccgttttaataaatacgcgcaagaaatgtataaggcaaaaggcataatgccgacgcatcaatacatgccgattcctaactatgcagtcgaacaggccatttcttatggaaaagagctgaagcagacttgggaacgtccgggttgggcggaggataagagcaaagcgcaacaaagtataaattaaacctattaactgaataaaagatatgaaacgtatgagttactatataattggtctattattgtctttaatgagttggtcgtgttcggatgatgcagaaacaggcagagaagaaattccagtggaaactgatggcggatatttgttcgcccacatgactaatgcaaattatggaaagttatattatgctgtttcccgggatggcatcaactgggaaacactgaataaaggccggatcatcaatagcgcttacattggacatcctgatatttgtcagggacatgacggagctttctatatgattgcagtcaatccgctggctttgtggcgttcggaaaatctggtgacatggacatctacccagttgaatgaaatgatttttaatcgtagtaatgcacagggattctatactacctattattggggagcacccaaaatgttttatgacaaggatagcgaacagtacattataagctggcatgcctgcaacgacccggataaggacgattgggacagtatgcgcactctctatgtgttgacaaaggatttcgagacctatacggaaccacagaaattattcaattttaccggtacggatgagaatatggctattatcgatgctattatccgtaaagtaaacggtgtttattatgcgattatgaaagacgaacgcgatccggctgttgccccggaaacagggaaaacagtccgtattgccacctcttccaatctgactggtccttataccaatccgggagcacctgtcactccgaatgatatgatgcgtgaagcacctatttttatcgaacggccgaatcatagcggttggtttatttatgcggaatcttatgcagccaaaccttatgggtatcatttgtttcagtcgacctctatggacgggccatggaaagaacgtactttctccggacctaatgtaaaggatggtacggacagacccggcgcacgacacggctgtattgtgaaggtgaacgaaacagtttatcaagctctgctgaaagcatataaaaaataaatgtataatcttaatatgactgcattatgaaatattatatatatacggtccttctgttgctgttaacggcatcttgcagtgatgacgtacagaaatgggatcaatggccggaatggaaacttgcctctcctctttctgtaggaggtcaagtgttggatgaagagatttactctaattttcagggaaaaaagcttcatctggaaaaaggacaggaagtcgagttttcggggattgacgaaatagaatccattctttcaccggattactttgaatatgtgtccgaaaataaggcccgtttcaaaggagagacggctgattatagtgtgctttatgatcctgctaatgagcttttgtacatagaaaaagccggggcgacctatccggacggattatggttctgcggagccaactggggacatcctcaagcgaggctggttaccacaagcggttggagtatggacggacctaacaatgtgctttattgttataaaagtgccgacaatgtttttcaactgactctctatctggctaataacttctcatttaagtttttcaagcatagaggctggggagagggagacaatgagatcactactcttcccgaagataatatcactctaactacccctttcttggttgccggaaagacgggaggagattttattccgggaccgctgttccaacccggagtttatcttatcacgctcgatttgaacaataacacttgtgcttttgaagcgaaagatgagaatattcaagaacaatctttcctggttaacggtcaggaaatgggtatattagaagaggcttcatcttttctgggcattgctttggaacttcataaaggtgatgaagtgactttcagcaattttggtgatgtgagaaagatgcttcaaccggatttctttgaaaacataacaaaagataaagctacatttataggagtagacggaaactataaattgtattatgatccgataaacaaactgacatatctggaaaaccgctcggtaaattatccggatgggttatgggtttgcggatccagtttcggacatcctcaagccggacgggtgactgtcggtgcatggactttcaacttgccgagtgatgcattccagtgtgtgaaggtagcagacaatatttttgaaaccaccctttatctggttaaagatttccagtttaaattctacaaacaacgtccttggggaggtgaactggctagtactattgtcaatacgcaacctgttaatttattgggtaagggatggtattacagtgatccggcaacaggtggcactggtggcggacattttaccggtgattttgtagccggaccggatttcacaccgggagtatatcgtgtccggatagatttgaataagaatatatgtatgtttattgataaggtggatgaaggacaacttggaccggaatcttataaaataaatggtacggaactgactcaatctactaatccaagctatatcgctgtagagttaaacctcacgaaaggacaagtggtcgatttcgaaggatttagttatctggactatatgcttcaaccggaatactttacgaatgaaaatggacaatataagtttaacgctccggacggtaagtatcggatttcatataataaggatagagaacttatatatgtagagaaaacgaccgatacggaattcccggaaacagtatggataactggagctgccttcggccatcctagaatcagcggactccttcccgatgacattggaaattggggatgggataatccaaaagactttatttgttgtgtgaagaccggagatcgtgtatatgaaactaacctccttctgaacaacgatttcatgttcagattttataaaagaaaaggttggaataatgaaattacttcgtttgatgtgaccatcgtatctgaaggtgatttaatagcccggggcggttattgggatggagatcaatggaaggaaacagagaactttggaccgggaaataatttcagagccggtatatatcatgtcaaactggatatgaatacaaatacctgtacgtttacaaagagataatagtctgacataggtattagtgttacataagataaagaggccgggtttcaccgaaacacgacctctttatacaaatagcaatgtggctttttctttcagaaatgtcttatcatatagattctaaaaataatattcatgaagaatttcctatttgtcttaactttattgttttcattatcatccttttcccagtctccggtcgataagtcttttcctccggaagagttgtttgctttgggctcttactattatcccgagcaatgggattcctcccaatgggagcgtgatttgaagaaaatgtcggaaatgggcatcaaattcacccattttgcagagttcgcctggtctatgatggaaccggaagagggagaatatcattttgaatggctggatcgtgcagtctctctggcggagaagtatggtctgaaagtaatcatgtgtacacctacccccacgcctcccgtctggctgtcgaaaaaatatcccgacatactgattcaacgggataatggagtgaccattcaacacggacgacgtcagcacgcttcctggagtagcgatcgctatcgtcattatgtagaaaatatcgtttcccgcctggcaatacattatggcaataatcccactgttatcggctggcagattgacaatgaaccgggacactacggggtggtagattacagtgaaaatgcacaagccaaattccgtatctggttacagaagaaatacggcactattgacaaactgaatgatacctggggtgcctctttctggagtgaaacctatcagaacttcgagcaggttcgccttcccaaccagcaggaagtacctgataaggccaatcctcacgccatgctcgatttgaaccgctttatggcggatgaactggcaggctttgtcaatatgcaggcagacatccttcggcggcatatccacaaagaccaatggatcactaccaacctgatacctattttcaatccggtcgatccggtacggatcgatcatccggacttcctgacctacacccgctatctggtgaccggacataatcagggaataggcagccagggtttccggatgggtattccggaagatctcggtttctcaaacgaccagttccgtaatcgcgtaggtaaagcctttggagttatggaactccaacccgggcaggtgaactggggagtgtataacccccaacctttacccggtgccatccgtatgtgggtgtatcacgtctttgcaggtggtggaaaattcgtatgcaattaccgtttccgtcaacctctgaaaggcagtgagcaatatcattacggtatgataatgactgatggagtaactctttctccgggcggtgaagaatatgtacgcattacgcaggagatgaaaaaactgcgtgccgcctatgataagaaaaatcgtatgcccggtcaactggcctcccggcgtattggtttacttttcgatatgagtaattattgggaaatggagtttcagcggcagacggatcaatggcggacgatggctcacgtgcataaatattacaatctgctaaaatcttttgcagctccggtagacgtgatttcggagaaagaggatttttccggttatcctttcttgatagctcctgcctatcagttgcttgacaacaagctggtggaacgttggactgaatatgtgaagaagggaggacatctgatcctgacttgccgtaccggtcagaaagaccgtgacgccaaactgtgggaggctcctttggctgctccgattcatcaactagccggaataaatagcctgtattatgaccatctgccccacaatctgtacggaaagatcgatttcgagggtaaggaatttgcctggaataattggggagacgtactgacaccggctgccggaacagatgtgtgggctgtctatacagaccagttctataagggagccgcttccgtgatacaccacaaactgggtaagggaacggtcacttatatcggaacggataccgatgacggcaaactggaaaaagaggtggtacgtcgtgtatatacagaagcaggcgtatcgaccgaagatttgccgtacggagtagtgaaagaatggcgtgacggtttttacatcgccttgaattatacgtcggacattcaggaaagcataaagagaaattaacaaatgttaatccaccccccaagaattacaactgagccatcttgtattagtatcctgtttgtcgttttaagtatatacatatttccaaatgtcttttagattccttatatttgtttaccggcttgaaagattcggtaaatgtgtcatttagtaataaaaaaggggaaaaagcggaataaaataggtgtaggactgtgatttttttgcaaacaaatctttttcttttcttctttctcttttttatcaaattgatttttgtaaatttggcgagaatctgacaaaggacacatagttaatatagtaataatactaaatactcctgttaatatggaaaacaaaattcaagagttgaccgataagatttatcgtgaaggcgtggaaaaaggaaacgaggaagcgcagagacttatcgcgaatgctcaggaagaagctaagaaaatcattgaggatgcccgaaaagaggcagaatcaattgtaaactcctctcgtaaatctgctgatgagttagcagaaaatactaaatcagagttaaaactattcgccggtcaggctgtgaatgcgctcaaatcagaaatcgctacaatggtaactgataagttgataaccgcttccgtgaaagatttcgctcaggataaagattacctgaatgcgtttatcgtagcattggcatccaaatggagcatagatgaacctatcgtcatctcaacagccgatgcggaatcactgaaaaagtattttgcagctcatgcaaaagctttattagacaagggggtgaccattcagcaagtaaatggtatcaaaactctgttcactgtttctccggcggacggttcgtataaggtgaacttcggagaagaagaattcatgaattacttcaaagcgttcttgcgtcctcaattagtagaaatgctattttaaaagaagcgactatgagtagtaagtactattacttggtagcaggtttgccggaactttcgctggaagacagcaaactgagctatacagtagccgattttaaaactgaaatctacgatggattgtctgcttcagaccagaagttgattgacttgttttatctgaagtttgataatgcaaatgtgctgaaacttctcaaagataaagaagcggaaatcgacaaacggggaaactactctgctgacgaactctctgaatatatttctattctgagagaaggcggagaaatcagtcctaaagaatttccggtctatctatccacttttattactgattatctgaatactccggctgaaagtacggttttacacgaggatcatctggctgctctatattatgagtatgcgatgaactgtgggaataagttcgtttctgcctggtttgaattcaacctgaacatcaataatattcttgttgcatttactagccgtaaattcaaatgggatattgcttccaacgttgtgggaaatacggaagtatgcgaagcattgcgtacatcgagtgcccgcgatttcggattgtccggtgaggtggatgtgtttgaatcgttagtgaaaatcagtgagattacagaactggtggagcgtgagaagaagttggatgctttgcggtggaattggatggaggatgctattttcttcgactatttcactatcgaacgtattttcgctttcctgctgaagctggaaatgattgaacggtggatttcactggataaggaaagaggtaatcagttgttcagaagcattatcgaatcgctgaagaacgaagtgcagattcctgcagaattcagataataaaataaaaaaaatatatggcaacaaaaggaactgttagtggcgttattgccaacatggtgaccctcgtcgttgacggaccggtagctcagaatgagatttgttatatctcgaccggtggtgataagttgatggcggaggtgattaaggttgtaggttcacatgtatatgtccaggtgtttgaaagcacacgtggactgaaagtgggcgccgaagccgaatttacaggacacatgcttgaggtgacattaggcccgggtatgctatcgaaaaactatgatggtctgcaaaatgacctcgacaagatggatggagttttcttgaaaagaggacaatatacatatccgttggataaagaacgtgtatggcacttcgtacccttagcgaatgtaggtgacaaagtgcaggcttctgcatggttgggacaggtggatgaaaacttccagccgctgaaaattatggccccgttcactatgaaaggaacggctaccgtaaaaacaatcatgccggaaggtgattataagatagaagatacaattgccatcctgacagacgaagaaggaaatgatattcctgtgactatgattcagagatggcccgtgaaacgtgcgatgacgaattataaggagaaaccgcgtcctttcaaattattggagactggtgtacgtgtgattgatacgctgaatccgattgtggaaggtggtacgggatttatccccggtccgttcggtactggtaaaacagtgcttcagcacgctatctctaaacaggcggaagcggatatcgttatcattgcggcttgtggtgaacgtgccaatgaggtggtggaaatctttaccgagttccccgaactggtagacccgcatacgggacgtaaattgatggaacgtactatcatcattgcgaatacttccaacatgccggtagctgcccgtgaagcatctgtatatacagcaatgacactggcggaatattaccgttccatgggattgaaagtcttgttgatggcagattctacttcccgttgggcacaggctttgcgtgagatgtccaaccgtatggaagaattgcctgggccggatgctttcccgatggatatttcggctattatctccaacttctacggtcgtgcgggatatgtaaaactaagtaatgacgaaacgggttctattacgtttatcggtacggtatctcctgcgggtggtaacttgaaggagccggtgactgaaaatacgaagaaagtagcccgttgtttttatgctttggaacaggatcgtgcggataagaaacgttatccggcagtgaatccgattgattcttattcaaaatatatcgaatacccggaatttgaggagtatatcaaaggtcatatcaatgatgaatggattggaaaggtaaacgaactgaaaacccgtttacagcgcggtaaggaaattgccgaacagatcaatatcctcggtgatgatggtgtaccggtagaatatcatgtgattttctggaaatcagaattgattgactttgttattctgcaacaggatgcttttgatgaaattgatgcggtaactccgatggaacgtcaggaagatattctgaacatgataatcgacatctgtcatacggaatttgactttgataacttcaacgaagtaatggattacttcaagaagatgattaatgtctgtaagcagatgaactactcgaagttcaaatcggaacagtatgaaggattccagaaacaactgaaggaattgattgccgaaagaagtgtcaattcataatctttaatttataattttaattatcaaagatggcaacaaaagcttttcaaaagatatataccaagattactcagattaccaaggctacttgttcgctgaaagcgacaggagtagggtatgacgagcttgccactgtggacggtaaactggcacaggtggttaagattgccggtgacgatgtcactttgcaggtatttgaaggtacggagggtattccgaccaatgccgaagtagtattcctcggcaaatcgcctacattgaaagtgagtgagcagctggccggacgtttcttcaacgctttcggtgatccgattgatggaggtccggacattgaaggacaggaagtggaaattggcggtccgtctgtgaacccggttcgacgtaaacagccgtcggaactgattgcaacgggtattgccggtatcgacttgaacaatacactggtatcgggtcagaagattccgttctttgccgaccccgaccagccttttaatcaggtaatggcaaatgtagccttacgtgctgaaacggataagattatcctcggaggtatgggtatgacgaatgacgactacctgtactttaagaatgtgttctctaatgcaggtgcgctggaccgtatcgtgagtttcatgaatacgaccgaaaatcctccggtagaacgtttgttgattccggacatggcattgactgctgcagagtattttgcagtaaataataatgagaaagtgctggtgctattgacggatatgacgagctatgcggatgcgttggcaattgtatctaaccgtatggaccagattccttcgaaagactctatgccgggatcgctttactcggatttggcaaagatttacgaaaaggcggtgcagttcccttccggtggttcaatcactattattgcggtgactactttgtctggtggagatattacgcatgctgtacctgataatacgggttacatcactgaaggtcagttgttcctgcgtcgtgatagtgatatcggtaaggtaattgttgacccgttccgttcattgtctcgtttgaaacagctggtaaccggtaagaagacacgtaaggaccatccgcaagtgatgaatgccgctgtacgtctgtatgccgatgccgctaacgctaagacgaagatggaaaatggtttcgacctgaccaactacgacgaacgtacgttggcttttgcgaaggactattccaatcagttattggctattgatgtcaatcttgatactactgaaatgctggacgttgcctggggcttgttcggtaaatatttccgtccggaagaagtgaatatcaagaaagacttggtggatcaatactggccgaaacaaaataattagacaattagacgatttgctattaggatgatagtggacggattatatatgtttataagaagtaatttcaatcgtctgatcgtaaattgttaaattagtaaatcaacgagatggctataaagtttcaatataacaaaacctctcttcagcagctcgaaaagcaactgaaagtgcgggtgcgtacgcttcctattattaagaataaggaaagcgccctccgcatggaagtgaaacgctgtaaaacggaagctgccgatctggaggataggctcgaacaacaaattcaagcctatgaagccatgttcgccctttggaatgagtttgacgcttcattaataaaggtgaatgatgttcatcttggcgtgaaaaagattgcgggtgtgcgcgtaccgttgctcgagaatgtagaattcgagatacgtccgtacagtatgtttaatgctcccaaatggtatgccgacggtatccatctattggaagagctggctcatacggcaattgaacgtgaatttatgctcgccaagctgaacttgttagaacatgcaaggaaaaagaccactcaaaaggtgaacctttttgagaaggtgcagataccgggttatcaggatgcattgcgaaagatcaaacgattcatggaagatgaagaaaacttgtcgaaatcttcgcaaaagatcatgaagtcccatcaagaaaaaaggaaggaggtagaggcatgattacaaaaatgaagaaactcacattcctggtttatcacaaagagtatgaagaattcctgaacagtctgcgtgaacttggggtagtccatattgtggagaaacaacagggggctgctgataacacggagttgcaggagaatattcgtctttccaatcgcttggcggctaccttgaagttgcttcagaatcagaagcatgaaaagaatgctgtaattgctacggaaggtggaacggctgcccgtggtatgcaagtgctggacgaagtggatgccctgcaaacagagcatggaaagctgtcgcagcagttgcaaagctatgccaaagagaaagaagcgctggaagcctggggtaactttgaaccggataatgttcagaagctgaaaaatgccggttatgtaatcggtttttatagctgttcggaaggaaattacaaggaagagtgggaaacggaatacaatgcaatgattgtgaaccgtatctcttctaaagtattcttcgtgactctgacgaaaggcgggcaggaagtggatttggatgtagaacaggcgaaattacctgcatactctttggcacaccttgaaacgctttacaatacgaccgaacaggccgttgaagagaatgaaaagaagctggttacgttttccgaaacagaaattccttccttgaaggctgctctgaaagagttgcaaagccagattgagttctctaaggtggtgttaagttccgaacagactgccggtgacaaactgatgttaattgaaggatgggcacctgcattcagtcaagtggaaatagaggcttacttgaatgacgcacatgtatattatgagattaccgatccgatgccgggcgataatgttcctattcgattgaataataagggattctttgcctggttcgaaccgatctgtaagttgtatatgcttccgaagtataatgaattggacttgactccgttctttgccccgttctttatggtctttttcggactttgtctgggagattccggatatggggtgttcctgttcctgggagctacggcctatcggttgatggcgaagaaagtgactccgtcaatgaagtcgatcatttcattgatacaggtattggctgcttcaacattcttttgcggtttgctgacaggtacgttcttcggagcgaatatctacgatttgaactggccgattgttcaacgtctgaaacatgccgtcttgatggataacaatgatatgttccaattatcgttgatattgggagctattcagatactattcggtatggtgttgaaggcggtgaatcagaccattcagtttggcttcaaatatgcagtggcaactatcggatggatcatcctgctggtttccatggcagtttcggctttgttgccggaggtaatgccgatgggaagtacagtgcatttggttattctgggtgtttcggctgctatgatcttcctttataacagtccgggaaagaatgttttcctgaatatcggactgggattatgggattcatataatatggtcaccggtttgcttggcgatgtattgtcttacgttcgtctgtttgccctcggactttccggaggtattttggcgggagtattcaacagcctggcagtaggtatgagtccggataatgtaatagcaggcccgattgttatggtactgattttcgttatcggtcatgccatcaatatctttatgaatgtgctgggtgcaatggttcacccgatgcgtctgacgttcgttgagttcttcaagaactccggatatgaaggaggcggtaaagagtacaaaccgttcagaaattgaaaatttgaagattaagaattagaaattgagaattaatattttaagaattaaacaataaaaaatagaataagattatggaaatgaatttgtttatcgcctacattggcatcgcgattatggttggtttgtcgggcatcggtagtgcttacggagtaactattgcaggtaatgctgctatcggagcattgaagaagaatgatagtgcattcggtaacttcctggtattgacagctcttccgggtacacagggtctttatggttttgcaggttatttcatgtttcagacaatcttcggtattttgactcctgaaattacacctatccaggcatcagcagtgcttggtgcaggtattgctctgggattggttgctttattctccgctatccgtcagggacaagtttgtgcaaacggtatcgcagcaatcggacagggacacaatgtatttagcaatacgttgattcttgccgtattccccgaactctatgcaatcgttgctttggctgcaaccttcttgattggtagcgcactcgttgcataatttttagcaagaatatttcctataaaggactttcaatccccttgtacatgctgctttgcatgtgcaaggggatattcttttttcattatagggcaacgtttctttcctcttcttaactcatatttttcgcataaagtattatttttcaaagaataatgtgtacttttgcactcgcatactaaaaagagttttaatatattatatggtaaaagatttattaacccccgattatatcttcgagtccagctgggaagtatgtaataaagtgggagggatatacaccgtcttgtcgacacgggcaaatacattgcaggaaaagttccgcgacagaattttcttcataggtcctgatgtatggcaaggaaaagaaaaccctctattcatcgagtcggataacctatgtgctgcctggaaagagcatgcgcttgagaaagacgaactttctgtccgtgtgggacgatggaatatccccggtgaacccatagtcattcttgttgatttccaacctttttttgaaaagaaagacgatatatacacagaaatgtggaatcgttatcaagtagattcgttgcacgcctatggcgattacgacgaggcttctatgttttcctatgccgcaggaagagtggtggagagtttctatcgctacaatctgacggaaacggataaggtggtatatcaggcacatgaatggatgactggaatgggagcactttatgtacaggaaactgtgccggaggttgctactatttttacgacccatgctacgtctatcggtcgttccattgccggcaataataagccgttgtatgactatctgtttgcttataatggcgaccagatggcgcaggaactgaacatgcaatcgaaacactcgattgagaaacagactgcacattatgtagactgttttactacggtgagtgaaataaccaataatgaatgcaaggaattactggataaaccggcagatgttgttttgatgaacggttttgaagatgattttgtgccgaaaggaagcacgtttaccggcaagcgtaagcgcgcacgtaccttgatgcttagtgttgccaataaattattgggaacaaatctgggtgatgatacgttaattgtcggaaccagtgggcgatatgagtttaagaataaaggtattgatgtttttttggaatcattaaaccgcttgaacagggataagaaactgcataagaatgtgttggcattcatcaatgtacccggttgggtgggagagcctcgcgaggatttgcaggcacgtttgaagagcaaagataagttcgacactcccctcgaagtaccgtttatcactcattggctgcataatatgactcatgaccaggtgttggacatgttgaaatatctgggaatgggcaatcgtccggaagataaggtaaaggtgatttttgttccttgttatctggatggtcgtgatggtatcatgaataaagaatattatgatatattgctggggcaggatttgagtgtctatgcttcttattacgaaccgtggggatatactccgctggaaagtgtagctttccatgtgccgacaatcactacggatctggcaggattcggactttgggtaaacagcctgaagaaccagcatggcattaatgatggagtggaagtgctgcatcgttcggactataattattcggaagtggcggatggtatcaaagatacgattacgttgtttgcggataagactgataaagaggtgaaggaaatccgtaagcgtgctgctgaagttgcagagcaggctttatggaagcactttatacaatattattatgaagcttatgatatcgctttgcgtaaggcaaggatacgtcagttgagttaagaaagaaattatttatcaataagtaaacgaaaacattatgaaaatcaaagttagtaatgtgaatactcccaactggaaagaggttactgtgaaatcacgtataccggaagagttggagaagttgtctgaaatcgcacgcaacatttggtgggcatggaattttgaagcgactgaactgtttagagatctagatccggaactttggaaagaatgtggacagaatccagtactgttgttggaacgtatgagctatgagaagctggaagcgctggcaaaagacaaggtgattctaagaagaatgaatgaagtttatacgaaattcagagattacatggatgtgaagccggatgagcaacgcccatctatagcttatttcagcatggaatatggcttgagcagcgtcctgaaaatatattccggtggtctgggcgtattggctggtgactatctgaaagaggcttccgacagcaatgttgatttgtgtgcggtaggtttcttgtatcgttacggctactttactcaaacgttgtctatggatggacagcagattgccaactacgaggcacagaacttcggtcaacttcctattgaacgcgtaatggatgccaatggtcagccgttgatagttgacgttccttatcttgattattttgttcatgcaaacgtatggcgtgtgaatgttggacgtatttctttgtatctgcttgatacggataatgaaatgaacagcgaattcgaccgtcctatcactcaccagctttatggtggtgactgggaaaaccgtttgaaacaggaaatcttgttgggtatcggtggtatcctgactctgaaagctctgggtatcaagaaagatgtttatcactgtaatgaaggacatgctgcattgattaatgttcagcgtatctgcgactatgtagctactggattgactttcgaccaggctattgagttggttcgcgcttcttctctttatactgttcatactccggtgcctgcaggtcacgactattttgacgaaggtttgttcggcaaatatatgggtggttatccttccagaatgggtatctcatgggatgacttgatggatctaggacgtaacaatccgggcgacaagggcgaacgtttctgtatgtctgtttttgcttgtaacacttcacaggaagtgaacggtgtaagctggctgcacggaaaagtttctcaagaaatgttctcttctatctggaaaggttatttcccggaagaaagccacgtaggatatgtaacgaatggtgttcacttcccaacttggagtgcaacagaatggaaagaattatactttaaatatttcaacgaaaacttctggttcgatcagtctaatcctaagatttgggaagctatctacaatgtgcccgatgaagagatttggaagactcgtatgactatgaagaataagttggttgactatatccgtaagtcattccgcgatacatggttgaagaaccagggagatccttctcgtatcgtttcactgatggataagatcaatccgaacgcattgctgattggtttcggccgtcgttttgctacttacaaacgtgcacacttgctgttcaccgacttggatcgtctttctaagatcgtgaacaatcctgattatccggtacaattcctgtttacaggtaaagctcacccgcacgatggagcaggccagggcttgattaagcgtatcattgaaatctctcgtcgtccggaattcctgggtaagattatcttcctcgagaattacgatatgcaactggctcgtcgtctggtttccggcgttgatatctggttgaatactccgactcgtccgttggaagcatccggtacatctggtgaaaaagctttgatgaacggtgttgtcaatttctccgtattagacggatggtggctggaaggttaccgtgaaggtgcaggttgggcgttgactgaaaaacgtacttaccagaatcaggaacatcaggatcagctggatgctgctactatttacagtattcttgaaactgaaatccttccgttgtattatgcacgtaataagaagggatattctgaaggctggatcaaagtggtgaagaattctatcgcacagattgctcctcattataccatgaagcgtcagttggatgattactatagcaagttctattgcaaactggcaaaacgtttccagactttggctgctaacgataatgcaaaagcaaaagaaatcgcagcttggaaagaagatgtggttgctaaatgggattctattgaaatcgtatcttgtgacaaggtagaagagctgaagaatggtgatatcgaaagcggaaaagaatatactattacttacgttatcgatgaaaaaggcttgaatgatgcagtgggacttgaattggttactacttacacaactgcagatggaaaacaacatgtttactctgtagaaccgttcagtgtagtcaagaaagaaggcgacttgtatacattccaggttaaacacagcttgtcaaatgcaggtagtttcaaggtgtcttaccgtatgttcccgaagaatccggaacttccacaccgtcaggacttctgctacgtacgttggtttatctaattgcttgaaaaagtaggggagtatatctccctcactttcatacataatattcagcccctgtattctttgagaatggcaggggctgaatttttttatctgtttggagagtggggcgtaaagtctcgcaaataaaaaagactgtctcattttctatttgagacagccttgtataaatttcaagggctttggaaaagcctttctttggatttgttattttacggcttctgctattttagcttgaagttcttctccgtgcagaccgcgagcaataatcttaccgctaccgtcgatcaatacagtgtgaggaatgctgtttacagcataaagctgtgcaccttcactttgccagaatttcaggtcggacatttgcggccaagtcatgtctagcttcttgattgcttctttccatgcagcaccatcctgatcgagagatacacctacgatttcgaagtttttgcctttgtacttagcgtatgtttctaccaggttaggcatttcgcgacggcaaggaccgcaccagctagcccagaagtcaaccaataccacttttcctttgcctacataatcagacaatttcactgtctttccttccggagtctgcatttcgaaatcaacaaattgagtacctacagcagtctttttctgcttgtcagtcatctctttgattcttacgattgtttcgtcattctggaaattagcaggaatttgttgcaacaaagcttcattttcgtccgtagagttattgtagaaagtttgtttaaacaagaatactccaaccgggttggtgatattcttttgtacgccttctttgattgctttgtcatattgttcttccagctgagcaccttctttttgtttggcctctttttgctcatcacttaaagatgtattgcccattgcctcataaatggcattcatttttttgctgatgtcattgatttgagctctgatttcctggtatgcatcgttgttgggagtaccggtaacagcgtcattatccttggtcagggcaacgttgatttttccgttttccaggaagaagtcgatcatcaacggttctccgttcacttcacaagtgacataacggctaaccacagagtcttgtgtgccttcaaaggtaaaagtacctttggtgataacggctgtatctagtttggtcagatttctaccattggcttcctgaagataaacggtgtcaccatcgcttgcaccttctactgtgcctgtaatagtgtatccggctttgtttccgccagtacaagctaccatgcttaacgctgccgttgcaataactaaataagtaaactttttcatgcttttgtaaaattggtgaataaatatttatgcaaagatagattttttttctgtcgggcatcgaaaaacactgttatattagattaacacgtaggtggaaaccgcagaaatgtgtacctttgcagcccaaactttagtatgaatatgcaagaagataaatccatcattgaggtgagccatgtatcgaagtactttggcgataaaacagcattggatgatgtgactctgaacgtgaaaaagggcgagtttgtgactatccttggtccttccggttgcggtaaaaccacgttgttgcgtctcattgctggttttcagacagcttcggaaggcgaaatccgaatttcggggatggaaataacacaaactcctccccataagcgtccggtgaatacggtattccagaaatatgccttgttcccgcacttgaatgtgtatgataacatcgctttcggcctgaaactgaaaaaaacaccgaaacagaccattgagaagaaggtgaaagctgctttgaaaatggtaggcatgacggattatgaataccgcgatgtggattctctttccggtggtcagcaacaacgtgtagctattgcccgcgccatcgtgaatgagccggaagtgttgttgttggatgaaccgctggcagcgctcgatctgaaaatgcgtaaggatatgcaaatggagctcaaagaaatgcataaatctttgggaatcacgtttgtgtacgtcactcacgatcaggaggaggcacttacgttaagtgacacgattgtcgtgatgagtgaaggaaagattcagcagatcggtacgccgattgatatttataatgaacctatcaatgcttttgttgcggactttatcggagaaagcaatatcctcaacggtaccatgattcatgataaactcgtacgtttttgcggtacggagtttgaatgtgtggatgaaggatttggcgagaatgttccggtggacgtagtcattcgtccggaggatctttatattttccccgtttcggaaatggcacagttagtaggagtggtagagacttctatttttaaaggagtgcattatgaaatgacggtgttgtgcggcggatatgaattcttggtgcaggattaccatcattttgaagtaggggctgaagtcggtctgttggtgaagcctttcgatattcatattatgaagaaagagcgtgtttgcaatacattcgaaggaaaattgctggatgctactcatgtggaattcctgggctgtaactttgaatgtgttccggtggaaggaattgctttcgatacgaatgtcaaagtggaagtagactttgaaaaagtgattcttcaggataatgaagaagacggaacgctgacgggtgaggtgaaattcatcctttacaagggtgaccattatcatctgactgtattgtcagattgggacgagaatgtatttgtagatacgaacgatgtatgggatgacggtgaccgtgtaggtattaccatccctccagatgctattcgtatagttaaaataaccgattaacaggaaaggaagtgaataagaggtttatagtctttttgtcatcacgtaagagttggactctcccttacattattttttcggcgatctttgtgattataccgttgttcttaattgtcgtatatgcctttaccgatgatagcggccatttgacactcgccaattttcagaagttcttcgaacatcccgaagcaatcaatacctttgtctattcgattggtattgccattattaccacccttgtttgtattttactgggttatcctgctgcctggatattgagtaacagcaagctgaaccgttccaagacgatggtcgtactgtttattttgccgatgtgggtaaatattctggtgcgtacccttgctactgttgccttattcgactttttcagtgtgccgttgggcgagggagcgttgatattcggtatggtatacaactttatccctttcatgatttatcctatctacaatactttgcagaagatggatcatagctatatcgaggcggcgcaagacttgggagccaatcctgtgcaagtctttctgaaagcagtccttccgctttccatgccgggggtgatgagtggtatcatgatggtgttcatgccgactatatcgacatttgccattgccgagttgctgacgatgaataacatcaaactctttggtacgacgattcaggaaaatatcaataacagtatgtggaactatggagcggcactttcgctcattatgttgctattgatagctgctacttccctgttcagcaccgatgataaggaaaactcaaatgaaggaggcgggctatggtaaagaagatatttgcacagacttatttgtggatattgctgctcttgctttattctccgatcgtgattattgtgatctactcatttacagaggcgaaagtgttgggtaactggacgggattttctaccaaactttattcttcgttattcactaccggtgctcatcattctttgatgaatgcattgattaatacgatcactatcgctctactggctgcaacagcatctacgttattaggaagcatcgctgctatcggtatattcaatctgaaagcccgttcacgcaaagcgatcggatttgtgaacagcattcctattctgaatggtgatattatcaccggtatatccttgttccttttgtttgtatctctggggatcacacaaggctacacaaccgtagtgcttgctcatattactttttgtaccccgtacgttgttttaagtgtattgccccgtttgaagcagatgaatccgaatatttatgaagctgccctcgacttgggagctactcctatgcaggccttgtggaaagtcataattccggagattcgtccgggaatgattagcggctttatgcttgcactgacactatccattgatgattttgccgtaactgtattcactatcggtaatcaaggtttggaaacgctttctacttatatctacgccgatgcccgcaagggaggtttgaccccggaacttcgcccgctttcggctatcatttttgtcgtggtactggcgttattggttgtaatcaattaccgggcaggaaaaacgaagaaaaaagattaatagactatcaaatgtgctactacgtaaataatatgaaaagaataattcctgctatcctgctcttattggctttgaccgggtgttataattccggtgaacctcgtgagcgggttcttaaaatctacaactgggcggattacatcggcgaaggtgtacttgaggatttccaggcatattataaagaacagaccggtgagaatatccgtatcgtttaccagacattcgatatcaacgaaatcatgttgacgaaaattgaaaaggggcatgaagattttgatgttgtttgtccttcggaatacatcatcgagcgtatgctgaagaagcatttgttgctacctatcgacacgaatttcgcacattctcccaattacatgaataatgtggctccatttattcgtaagcagattaataaattgagtcagccgggtgaaaaagccagccgctatgctgtatgttatatgtgggggacggcaggtattctgtataaccgggcttatgtgcccgattcggtagccctgtcctgggattgcctttggaataaaaagtatgccggaaagatcctgatgaaggatagttatcgtgatgcttatggaacagccgtgatttatgcgcatgcaaaggaactgaaggagggaacggtaacagtggaagagttgatgaacgactattctccacgtgcgatggagttggctgaaaaatacttaaaagccttgaaaccgaacattgctggctgggaagcggactttggcaaggaaatgatgacgaaaaataaagcttggctgaatatgacttggagcggtgatgcaatctgggcgattgaagaggccaatgcggtaggagtggatttggattatgaagttcccgaagaaggaagtaatatctggtatgacggttgggtgatcccgaaatatgccaggaatccggaagcggctagttattttatcaactttatgtgtcgtccggatatagccttgcggaatatggatttctgcggatatgtaagttccatagctactcccgaaatactggaagagaagatagacaccactcttcattattattccgatttaagttactttttcggaccgggtgcagacagcgtgcagattgataaaatacaatatccggatcgtaaggtggtggaacgatgtgccatgattcgtgattttggcgataagacaaaagaagttcttgatatttggtcgcgtattaaaggagataatttgggagtgggtatcactattcttattttcgtcgttgttgcattgatgagtggttggatgatttataagaagtggcagcgttataatcgtcagaaacaacaaagacgtagaagcagaaggaaaaaggtcaggaggaattagtgtttctccggattgcaaacaaaaaataaattaggtggaaaataaaagcggtatctacggtaagaaataagaagcacggtgaacagaatgctgatggcaggatgttcgccgtgcttggtatttatcgtcttttcatttctcggagaatgtccttggtgtccttatctacccggaatgactcaattgttttttgcagtgccttgttgtaagtccagttatccagtgtgctatgtttcagatactccattgtcttttggggaaatttgataaaacacaatgatatcatccatgccatagccatgcgtgcataatatgcatcatgattgaatgagtcggcatatttcagtaacgaatcgatatgcgcgtcatctacataatggaaaagcatcacaattccgaaacgtatttcaaattctttagaggatttcagatagggttggataaattgccatacgttttcttttccttttttcacagaagttttcagttcactgcagaatatgtcgcatacagcccaattatctatacggggaatgaacatcgttacgtatttcatttgttcttcaagttccatttttgccagtccgataatcattccctgaagcattgtttcttcataataaatcgtatcggttgattcgacaaatgtacgccagtcttctttcttaataatttctttggccattgtccgcagttgggggatgcgtacgccgagaatgttgtttgctcccgggaggagggaagaatgaaattcctgatatttggaatctgctaatgtttgtaattctttccggatattttcagttgtagtcattttcatatcgttggttatttcacaaaggtataaaaaaagagtatgcgcgctgtgtgcaggcatactctttttggaggtaattcccatcataatgaaaatacgttgggaaagtttatccgatcagttactttttgaccatgtcgaaactgaatgtggtaaccgaaaagttttcaagcggctctccttctacttccacttgggtggctttgattacaaaggtgagttttttatctttatatgtatattgacccttttcttccgcttctatagttacttttacagtaatttgaggagcttcctctccctctgtttgtacttgggtagggatcgtgtattttatttccaaaggttcaggttttaattgaagtagaatggagcctttgctatcatcattaaaggctgcagtataaggaatgttgtaattgatatcacccaaagtctcaatgataatttcgcctatttcttcaccgacaatacttttaatcagatcgtcaactggaagtttttttatcataatctgattatcttttacttcagcggtaactgtggctccttgcggctgttcttctttgaaggaatagttttgtggattgacggatggagcagtttctgtcagcatattaccggaataattaccttccacatctttaagtgaatatacgggaatatcagaatcgtcatcactactacatgctgtaaaagtggctatcaggcctaatgacattactaagaaagcaaaacgattaaaacaacaagttttttttatttcagttataattttcatactgttttaaattagattattaatttcaaaattaaggtgtacgtacataaagtaaatgccggtacttgtgaaatactgcataaggaaataaaaatagaatatttttttttatatgagtattgccatgaagatccctgttcatgggatcttcaattataaaatattctttttattttatagctttttcgtaatggacttgcttggagttatcccgaaatactctttgtatttatggcggaaattcttaagatttttcaatccaatcatttcaggaataacctggacagagtattttccactctccaataactcacgtgctttttccatacgaatacgataaataaaatacttcggtgcttctcccgtcagtgctttccatttattaaagaaagcagttctgctcatatacagttcagaggcaatttcatctatcgtcagattttccttatctatattttttagaataaattcttttacttgattgatgaatgtgtaattactatcatctaaaactttctcttcttccttttccaagaactgctttccgaaaactgtctgcaagaatgatcttcttagagaacggttgtttttgataagtacattcatttctatctttaaatcttcgatgtggaaaggcacatataaaaagatgtcggccagggaactttctcttttgttgcgttgtcctatatctatacgtgaaccgtaaaggatgataggaataacggatgtttctcctgatgtctttagtcttgatgacagttcatagccatacattccatgcagcataaggtcgcaaatcactaaatcaggatatttctcttttatacattctaaagcttcagagccattcccgaaacttttcacatcaaaatcctttgataaacattcttccaaataagacttgaattcttcattactgtcagcgagaacaacagtaggcttgattgaactttttttatgagcaatcttacccaatgaagtatcagtctttctttcttccgacttttttgcggagtgtatgatattatatccggatacctttctttctgaatttgttgtaggaaatcttagtgagacagtgtgggttgaatgattgataagaatattcccatcacatagtttcattaattttttgcagagtacacttttggcaaatgcatatttgaactctgatttatgtttaggtttaatcaagtgatacttttggcgcctataacatgttagcaatttgcccttgttggcatcgaacgttttaagttcccagtgttcggaattagaagaaattgaaaagataatccttttatcttcaggtttcgaatgttctattgcgttttttatgaatttatcaatgatgggagagattttactttgatcgaaccaaacgctggcataattaaactctgtttttatttctaacttaatccgcttgtccgtagcgaaatttttcaatgaatggactctgttattaatgaagtttcccagttcatattcggcaatatccatctgtttggagtagataagcagatgtcgcagattcattaatttggttaggtgttcatcaagacagtctatattacgaatgactagtgataacattttctttatgtcttcggggcaactatcatcacaagcagctcttagaggggtatgaacgagtgtgatagggttgcgaatgctttgaaaagaatccatgaaatattggtgctcttcttttaagattttgatttccttatggagggtaagaaaatgagataagagccaatataatgaaattcctccggctgtaagtagtaagaagaagtgagactggtgaaagatatttgcatctataatagagacaaatagtgacgttatcattaagtatttcatatttattttttgttgaggtcacttggactgtatacctctgttcctttttagttgaggggggatgagaaaatgcacaacgagtgtgatttagggcattactaaactcaaacagtctaatctcaaaattatttgttctttgaaggtcaatattaagaaagcgagttccgtatgcagatttaaatccttacgtcttgaatcattctttaaggaatatctatttcctccaagtgacaataattaatagatcattttttctgaatatataatactaaatagagattctttgacggtggtgggcgtatcttgtatttgatactgtaatcttttggggctatcagtatcacaatatgctttttcatatgtaattcctaaggtaaagtaaacatattttctttattgaaatatagtttgtttttgcggagtaaaagtaatgatttggtataataaataaatgatgagttattggcaaatggtgtattgttattgtttggtgttgttttgtaggtgataagtgttgtgtttttgtattattttaattgatgatatttggtggaaatagtgaaaccggaactttaaccaaatagatggttaaaattccggttatattattttactgataataggcgcataagctcctgttagtaaggaaaggatttgtttttcctcccctgtttaattgataattctacatctcgtaatagtttttatcccctttcatatccttgtatttaccattatgcaaatagttgatgtccggttcatatttatggcctccttccactctataaaaggctgctgcccctgcatttatgttagcatgatatggtgttgcttccagtgcgtccgaccagaaagggatattacgcattatgtaaagtttgccaagacctttgtcatataacttttctcgtaacgtttccggatacgattcgtcattttcataatcgaacgtatattcgtcggtgctgaaaccgccatattgagatttgtccagtcctgctattggtttttcaatcgagctatcctcccatggattcataattttggtatttacccatgtccaggcataatcaatatattcacctgctctgatacccgcagcctcggaggctagtgaaccggccggatcacccgttatggtaactgtaatcagtttggtcttgcctaaagattcccgtagtgctttgatgagcttcggatacgaggtcgcattggcagccggatgtccgtttataccatattcggcaccttcgtccatgagattaatgccatctacacggtagttggcgagcttcttgacttccgctacaaaggctgtaatctgctcatctgtcaggttgcagaatcccaagccggtcccttctgctttaagggtgacgcaacgctttataccatagctggagagtgacgacatattgcttaactgctttttgaaattggctgattggttcagagtcacttttccattcgcatatcccagtgttgcggcattcacattaatgatgtcatataaataggcataccacgacgtttcccataactcataatgtccgggaccgaatgtttcattatcatataataccatgataaattctttggcaatggaggcgttgactttttcgccatcaataaaccctaccatcttgtactttttcatatcagccttcatcgggctcaaccacggataagtagagcgtttataataaatcttgtaatagatttcattactatcccgtgacggacgaattccgctttcttccggtagttctacggtaatagggagcaaagaataatcatgcaatgtgcctagcggattcaggcgtaccatgatagtatccgacattgtatctcctgccttaatagtcattgcaccatcgttactgatgccctcaatgctgatagtagacattttccggtattccgtaccgtgttcttcattgtatttgtctactaagtcgaggtcgattttcattgtgattcgggtgtcctgtgccaccggcttcaccgtttggtagaagaatgcaaaatcgggagtcttggtattggtcatggtgatttccaggtcactggttgtcatatcacattttagcatgccaaagttattgtctaaagccgtctcgttaggtaatttacctacgggagtggcaatggaattatcttcgcagcctcctagcatgccggttactaatgtaatggcagccatgcagagaacatttttgaagtttatatttcttttcatgtccatggttatctttaaagtgaatgattacttgttgatttgtggaatttcgattcccgtcggccacacaagaggttcggcagatactgcatcgaatccgtgtttcgaatggtccttgacgatgtttccctcaccttcattaaatttccagtaagcaagcaggctttcttcgttttcaggatcttccactttatacatattcgtccagatttcctctttcgtacggcaagtgttccagatacgtatctctgcgatgttaccgttgagttgccgtagctcatcttcataagagcgtcctatctggaattcgcaatccggcgttccacagatatccacagtagctccttttccataagagatatcctgactttgcagttgtccgttcacataataggcaataaaatgttccttggcgttgtacaccagcgctatatgataccatgtcattgcattcagtgacttagccctgtcggcggcggggaatttgactccgtccggtccctgcatctgcaactgttggcgtgggaaacttgtatcacctatacgcattaagaaatgctgttctactcccatgatcgtactgatatccgatgcaccggccgtattgcttggtccgctgtatgtaaagtcctctacatataccagtgcttccatggtaatctgacctaattctttcagacaggcatttttctcttcgtcgaggaaagtaggcacttccagataattgtctttcaggttggcggctaccgtgatagcgcttgaacggcgcaccagatagaacaatgttttcgaaccgttcaatagatgaacgccacccgacgtttcagagatggtgagcggaaccagataagttttatcaatctccagatctaacaggttattaaaatagatcgtatcaatcaatgattcactcttttcggctttgataatcagttcgctgttcgacaggctataatatttactatccagcattccataatcagtcccgtgccgggcattgaattcgtttatcagtccgggatccgctttcagcttcactacgatgtcttttcctgccgggtaagtcaacttggcgctgaaggcacgtttctgttcattcagcgtatttcggaaagtcactctttctgaattgctgttactggcttccttgatatagaccatgttgttgaatggtgctttattgctgtaatccgtattgtcacaggcaatcatcagtccgcagatgattgcagccagagagatgattattttatatcgtttcatagttcctcctttcattaattaatcggtgatgggttcagtttttggatagcatcacgtatacggcggtagttagtcaccccatcggtggcgagataatcttcattggcattgtagatagaaactcctgccagcggaccattgttacccagtcctgtgatgaaatgattgatgatgtaggccatcccttccgaggtttgtataacatccaaatcttcccggctgatgataccggtcttaccgtcatcggtcggaggagtggctgtcgttatcactttctctttgggcattttcccatagaaacctacaggttggctcatattcagttttatttcgagtgagctttcaagcaacacaatttgcccatccacgaaatagtctaccaaatcgatgaacggctcttcgtatcttccgctataatccactgtaaatgtgacgatgccatcaaagaaaaccaactttccattattagctttcggaccgccgatagcggcaagtttttcccggatagccgtcgttacctcattgaagaaatcgacatgcatcatacttccggcacgaccaaactgcacataataaccgtcaaattcatcactctctccgtttttcaatgccgcattcattttcgttttgaattcttccaggttttctgtctcttcgcattggtcgtagaattcggataaattcttgtaatagagaaatttggtgccggtccgtttgagtttggatatgtcttccttatcatatacggacagattatcagcgttggtcagcaccacaaaatctacgctatcgggcaaggaacgcaagaaatcctgttcgcccaatgtcgtacccggattgttggcaaaacgtattaacattaacgtatgcttccggtttttgtattctttcagactttgctcgtatttttcatacaagctgtggtcttgttcgtcgggaaatatagggttgtaatcaaccggtgtcggttctgtccagtcgctacaggcaacgaacatcagtgagcaggctacggtcaatatgacacttatgaatgaattctgtttcattgtatcttgggtttaagttccacattattttacattcggattgcagtcccaccataagcgggtagcgccgttatcttctccattgagctttcgcagggcaccgagcatattttccgcattcagctgatattcttcggcaggataggagagacgtcgtattcccagtgtcaggttagtgattcccactcccttgttgtccattatcggaaggaatttaggataccctgtgcggcgatgttcgcaccaggcttcaatgcccagaggaaacatggcaatccatttttgagtaatgatacgttccaggttttcttcgaaacgggtattctccttgtcctcgttccaggcaatggtgatgctgctcggagattgggcgctgtatgtacctctcgggtctttgtaagcccccggcaccaatgctttattctgggagtatccgcttgctccgcttgcgccccattgctcaaaggaaagggtgatcgccttctcatatagctgttgggcatctccgctcattgcccatccccgcagggcaccttcggcacgaaggaatgtgacttcggcggcagtcatccacatatacgtatcattggcagtcatcaaacggttggaataggtttgtatcaactcgtcgtccgtcactttggaaggaagaataccaatgcgtagcccatagtaatcggtatcatcctgatactttccctgggtgaagtatttttccagacgcggatcgttatatccctgcatataggaaacgatttccgcagctatccggtaatccttccaatcattgaaacagagagctgaacgattctcctctacatgcagttgtgcgttgtcctcgttgttctctatcacacctgcggctacggctttctcggctatttccctggccagttccggtttcacataaacgatacgcatggccatgcgaagctgtaacgagtgaaggtatttataccatttccgcacatctccataataaagattatccagtttcttaaatccttccgcacttagaccgagattctccttcagagcttcatctgcttcttccaattccttgaacatagccacataaacctcctcttgagaatcataaggagcactaaggccgtcaccttccgttttatctcccaatactttggtatagggaatcggtccgaacatatccgtagaccggtgcatgatagcgactcgcagaatcttggcgaatgccagtgcgacggggtcattggtacggttgataatatcccggtaggaaggatacatttccgagataggatcggagaacgaagccttcagccagtccgacttgggattataagtcgagtatttttcagtccaacccacacgagtctctccaaaataacgcccgtaggctcctccgcacatcgcttccacaaattgataaagatgctcttgtgtgggaaccaccaatgcttccatgctctttagagacgagccgatgatatggttttcgcgcatcagttcatcctgcgttgtctcgtaaggattacgattgatatccatatcgatacaacttcccgtccatagcatcagcgttagcaggtatgccagtcggagggttgcttttctgtattctttcatttgagtattcatagttttagaagttaatctttacattaaaaccaaaattgcgtgtactgggcatcatgaagtagtcgattccctgatagaaattgcttgttgtggcaatcgcttccgggtcgaaaggtgctttgcaataaatcatccacaggttacgtcccactacagagacgttgatgtcgcagatattacccaaccatttgcgggggatggtgtatccgatgtgcgcttcctgcaaacgcagatttgtggcactatacgtataatattgcggcagcccgcttgaggtagctacaatctcgtaatactgctgtgcgttcacccagctacgtccgttgacgagtactccgccacggtcacgggcggcagcagatgcttcggatacgccatattggtcgagagcagcctgtgtggctgaataaacaatacctcccaggcgggcacttaattggaatcccgcataaatacctttgtaagaaaagctgttgttccatgccaggtttgctttaggaaatacgctgcctaatttgatgtcaggtagattatccgttttggcgacatccccatttttgtctatctggatatatcctttatcgtcacgtatgaagtcggcattcgtgtacaggtctcccagtgtgcctccttctttcaggataaatttggtatatcccagtccttttagttcaaggcggtctttgttgacgatttctccggtttcgggatgcacatagtccttaaccaactccacaattttgtttttattccaggagaaagtgaaattacagttccatccgaagtcgcgccatgtatgtccgtaagagagtagcccctcgacaccgagattgcgtacataaccggtttgcacataaagagtcgaatagccggaagacacggtgattttcgggtcgaatgtctggttataggtattggcatagtagaatgaaccactgactttgaaatccttgaagaaagttccgtccacacctatttcccaggagtcggtacgttccggtttcagtttgccgataggataatgggttttggcgttccagtcctgtttggtagggtcatagctgtaagtcggttgtaccagaaaacgcgggtagggggtacccacagaactgaatgacccgcgtactttcaggtaatcaatcgctttgggtaatgtcaccatttcgctgattactgccgaaagacctaccgatggatagaagaaagaagtaggattcgagcctttcaactgggaagcccagtcgttacgtccggtcaacgtcaggtacagcatgcttttccatcctatttccgcactggcaaaaatagactgcgtcatttcttcccaaccctcctgtgttgcccgtttcttggcgttgtccaaatcaaatacattgaatacgttgggcactcccgtgtcgcgaatcggaccaccgtaacccagtaaatcactggagttgtcgctcaatgaagtaccggcattgactactaccgtgaagtcgtcaatgcgtttattgatattcaccatgaagtcggcatacgtctgtgtttcgttcaccttttggatggtgtaatgtccctgggtactaccttcggtcagtgtagagatcgtacttgcgtatagcttttgctgataagtattgtcggtgttatccacgcggatacgtgccgatacattcagccagtccaaaatgtcgtatgtcagtccggcattcagcatataacgctttttctcattcgtgcggacgttccggtaagcaatccagtaaggattctgcatacgcaaatccccttcaccttgcggccagtaagccacattgattttacgtgcttcgtcataacgttcgaaggcttttactagagaaaagtcatcgccgcgtggaaacaggtaagccgaaactaatggattggaataaactccctgattggtcatgttgcggtcgttttgtatgatataactggctcctacatccaatttcatcttgtcattcaggaaatgagtcgtattgcgaaatgtgaaattatatcggttgtacctattgttcggaatcatcccttctgaattgactgctgcggcagaaaagaatgtttggttcttgtccgtacctgtcgagagggtgatggagttgctgtaagccgctcccgtatcaaagaagtcggtgggttcatatcctgtttggttggccggattcagtttaggcccccaacttaatatgggagaaccttccgcatcgccccgtgtaccggttccataccgattctgaaacttgggcaatacaaatgggttcataaattccatgctgcttgagaaagtagccgacagttttcctatctgtccccgcttggtagtcactacaatagcaccgttggcagcgttgctgccatacattgcggcggctgccgcacctgtcaggaaagagatgctttcaatatcgtcgggattaatatccgcaatggcttccgtagcacctttggagtcaaattcagtaccgcctccaccgccgaagttatacatcggaataccgtcaatgacgtatagcgcattactgctttgctcgatagactttgtaccacgcatcaccactttactggcacctcccacaccggaagaagaagcattaatgacaacgccggcagcctttccgctcaaactgttgataaagttggcgtcttttatttccggcatcttgtctgctccgatttgctggacgttgtagctcaatgctttttgctcgcgtttgatgccgagagcagttactacaacttccgatagctgttgcgtatcggctgtcagttgaatgcggtaattattctggttggtgactttaatgcttcctgaagtataaccgatataagtaaatgtcagtgtatttccggtggaagcttcgatcaggaagttcccgtcgatgtctgtgatagatccggcggcagtaccttccactttgatgttcactccgatcaagggatcgttgttttcatcaactaccttaccggtgatcttcttggccgggttgctttctttcttttgttccggaataatcatgatatatttctctttcagttgataggtgaaacctgtacctttgagaatttgagcgagtgcattttccaacgaagccgtctctatattgagggtgatggccggtttgtttttcagttgggaatcgttgtagcctacggacataccggattgtttttcaacttctttcagtgcttcaatcacagatatactattctttttaatagtgattttagcgccattttgtgcaagggaaactgttgtggcgagcatcaaacagaaaaaaagtataaaacttcttccctttgtcttcttgtctactataaatttataaatttgtagcattttcttagtattaggttattgactaaattatttcgaggtaatttgtagagtaaactctaatattgggaattcagatttcatatccgggacggagtgaggcctctgttccgggtatttttttgcatggcatataaggttaaaaagttatattcttgtcagatagcacttgtcttctactattctatagtccatttgtccgaccacgttcacgatgatttccatcacttcttcgagtggtgcgttgtccttgaaacgaaaactgaacctgtcgtttttgaggttcttgatactatatacaaaggtataaggatattttcgctccaatacgttgatgatgtccgtcagcgtcatcttttgcagaaccagttctccgcgttgccaggctgtcacatcgtccatatccgggttggagagatcatatttcttattgtttctgttataggcaaactgttcgttgggatggagaatgacacttgttgtcagattgttataatctacacggatactgcctgaaatgagagtggttgctatttctgggctttcagggtaggcagatacattaaattccgtacccaacgcagtaatctgtaaatcattggatttcacgataaacggacgtttcttgtccggcttaaccttgaagttggcttcgcctaacaggaatacactacgactatctccggtaaactcctgcggatataaaagtgtacttttcgagttgagttgcacttttgttccgtcgggcagcgtcaaacttctcatttctgctatcggaatatattgctgtaataagtcggtttccgcttttgcgcctacagtcgatagatagaccgaagaggcaagcaggaggaataagatagcggctgcggattgccatatatgtattgggcgaattcttctctctttgggtacggttggaataccttcctgttttttcaggcgctcgtaagacttctgcattcctttcacgtttttttgccgttgcgctttgttccacagctctctcaaagcatcttctttctgggatgcatgatcttcatccaccagccattgatagaattcattttgggtagcttccggatagttattgccggtaaataatatcagtattttctgaaaaaagttcctcatttgcgctgttctttttagtggttacactattagcacaatcgaaaatgggggattacttaaaagaaacacaagaaaaatgcaataaaaatagttttttttatttcgagcagggtcagatagatttggtgttccacagttcgtacggaaatattgagtgcttgtgctatctccatattactcatattgttgatgcggctcatttcaaaaacttttctgcggcgttcgggaaggcggtcgagaattaggcggatgattaatagtgcttctttataatagatagggtcgagagtatcttcggattttagtaagtcttcgattagatatttctgcgataattgttcctgataggattgttccagtcttttgcgtttgatgaaattgaaagttgtgtttttagtcatggcgtagatatactggcctatgtctttgttttccagccagacctccggttgtgtccataatttagcgaacacatcctgaatgatatcttctgcgtcctcttcagatttgagcaagtttatagcgaaatatttaacagcggaatagtgcgtggtaaatataatttcgaattggcgggctagatgaataggggcttggttttggctcataggtttatcaggtctgttggtatgagacaaatgtatgtaaataattcaacaatactaagaagccaagattagtatgcgaaaaaggaaactaaaaaaacgacttcaagttctgtgtttttatgaactcttaactgtgaaaaggaaaaaaatagtgacgctatccagtagggatggcgtcactattcgagtgagatggtgacggtataccaatgtgataccgtcactatttttagatatgtattttaccagtttcttttcacggtgcgatacccgtagccgataattacaataaaacagataaacggaagaatgaatgaaacattgacagccggtaaccaggctatttgttccatatcaatgatactcgcctgtaacggtggaagaacagaacctcccagaatagccatgataagaccggcagctccaaacttcgcatcatctcccatacctttcaaggcaatgccgtagatggtagggaacatcaaagacatgcaagctgatactgctaccaggcaatacattccgtagatgttttgcaggaagatagttcctaatgtgaaaatacctccaaagatagcaagaatcatcagcaatttacccgcattgagatagcgcagaatgaacgtacagataaaacggctgatacaaaatatcaccattgctatgatattatattgttgagatagtacttccgcacttttctcgtccataccttgtgacatgaacaagcgtgttccatactgaatgatgaaagtccagcacataatttgtgcacctacatagaaaaattgggcaattacaccttcacgataacgtgtttgggtgaaaatacgtttcagtgtagggaagaagtctattctatgattctgatctccattcttaggcatcttgacgaatcgtatcagaagcaacatggctacgataatcagtccgataatgagataaggagcaatcaggacgctaaggtcgctttctttgattgcttgaaattcgctgtcgttaagcaatgcgcggtcttcggtacacatcggatgtaacttcgcttgaatgaactgcatagctacatacattccgagaagtgaacccatcggattgaaagactgtgcaaggttcaaacgccgggtagctgtttcttccgttcccatagaaagaatatacgggttacaacttgtttcgaggaaagacaatccgcaagtcagaatgaaataggcaattagaaacggataatactcacctgtcattttggcggggaagaataagaatgctccgaaagcatacatccccagtcctaacaaaacaccggctttgtaggaatatttacggatgaatatggcagccgggaaagccattgcaaagtaccctccatagaaggcaacctgcaccaatgctccgtcggtggcactcatccggaaaatcttggagaatgcctttaccatcgggttggtaatatcattggcaaatccccataatgcaaaacaggaggtaatgagaacaaaaggtataagataactgatgccatctttcgagaggatggactgtttggggtgtttcatggtcgtttctggtattttttaagtgttatacaaatggaacattctctccatcggtttccatttctctgcggaactcattccgggtgcggcttgttggaagatagccatatattcttcccactcctgttggcggggaagggtgttcaggcgttccattgccgtgtcccagtcaaaatcaaggggagtttcgacaatcataaacagtcgggttcccaggatataaatttccatttccaggatgccaacttcccggatacctgcaagaatttccggccatgcttccgcctggctatgtcttttccgatattcggcgattagttccggagaatcgcgtaaatcaagggtttggcaatatcgtttgacgggaacgtcataagattgaacctgataaccggttttagatgtttccatatactttattttttaggataatatacttgtggtgtaacgctgcgagtgacaatttcccgcaattcacgaagattggcaacttctcctttagccattgcctgcgtcagaatgtttcccattgcagtggcttccaccggacctgcataaacaggaataccgagttcgtcagctgtcagttggttgagcaacttattttgtgatcctcctccgatgatatttaactgacggattggagcggggaggcaacggttgagctgttccacagccagccgatatctgaaagctaatgactggagcacacatcgtacagtctctaccttgttttggggaatttgcaaagcatgattccggcaataatgaataagcgcgttctccatattttccggattcatgaatatggtgtcgtctacagggatgattgtatcaatctcggcttcggctgcttgcgggatgattatatcataatcttgtttctcgccacacgctttccactcgctcatcaagcgttgcagaatccataatcctgttatattctggaggaaacggattttgccgtctacacctccttcattggtgaattgagcttttcttgcttcttccgtcaatatgggttcgtccacttcaactcccagtagcgaccaagtgccggaactaaggaaagcgataggactttctgcagcaggaacagcagctacggcactggctgtatcatgtgaacctacggcaataacgtctacggcacccagtccggtttcgcgtgcaatatcctctttcagagtgcctctgattgttccgggaagaatgattttcccgaacagatgttcgggaagacctaagctatgtatggtatcgaatgaccagttgcgtgatttggcgttgagtaattcagaggtggaggcgatgcaatattcattattggctacccctgtcaggaaataactgaagagatcgggcatgaataaaagttgccgggcaacttccaactgtgcatcttgattttgcttcatgctgtaaagttgaaacagcgtattgataggcatcacctgaataccggtttcggcataatgtcgacgttcatccatacacttgaatacttctgccggcattccctccgttcttgcatcccggtaacagacaggatttcctaacaggttcccatgtttgtcaatcagtccgaaatccactccccaagtgtcaataccaataccttttacggcatatcctttttgtgcagccagttttagtccggttttcatatcttcgaacagagccgggaagtcccagtaaatatgattgcctagtttgacctgccggttggagaagcggtatatctcttccaattccagcctgccgttgagaagaaagccggcgatgattcgcccgctgccgcctccgaagtctgctgctaaataagtgtgtttgatggtatctttcatggtaatatgcctggatattagttggttttctttcctaatacgtagatttccaggtcttcaatttctgccggtgtgagcactgaataatcaccgccggattgaacaatgatgcggcaagccatttcgaaaaaagtagcccgttcatatacttggtcgaagtcttttccgcacaccacttgtccgtggttggtcagtaaaaccgagttatgcttttgcatggcttctaccacggctttcgccagttccggtgagccgggacgataatacggaatcacaggtatttccgaacctacatggcaaggaatttctgctgttacgttgaaatttgccggcttgttcttcatgcaggagacagcggtggcatattccgattggaaatggagaacgacattgacgtccggacgttcacggagaatacccaaatggaatgtactttccatagagggttttacaccattggcaggaatgccgctggcaatatggcagattgaaaccttttctttgccaagtgtgggaacccaggaacccgtaccggaaatcaatgcttcttcgccgattctccaggaaaggttaccgctgctgcaaagcattaactttgcatccccgtaacgatgtgcttgtgcaatgaactgttcaatatgttcgttagtaatcatagtgttacttatttaagtcgctgtagggggcggggctatcccgacatttgttatgtgtcgggtgggggacccccatccctacgaacggcaaagttaaaatatttatttatacaggacgaaaaaaacttgtttatttatagatagggccataagttgcacaagctctgtagtctgatccttctttatccatgccgaaggcattccaggctgccggacggaacatctgatcttcttctacattgtgcatacatactggaatacggagcatggaagcaagagtgattaagtcctgaccgatgtgtccatagctgatagctccatgattggctccccagttattcattactgaatatacatctttaaaagccggtttttcgcacaggcggggtacaaaccaggtggtaggccatgtaggatctgtacgcatattgagtttctgatggatttccggatcaatttccactgtccaaccttctgcgatttgcaggacagggcctaagcctttaatcaggttgaggcgcatcatggtaacaggcattccgccttttgacaggaagttggacgagaagccacccccacggaagtagtcacggtctgccggataccaggtcgttgctttgagacagttctctacatcagcgtccgtcaggttccatggttctttcataaccggattgcctgctgcgtctaatgattggccggaaccgtcgagagtcgttgcaccggaattgataagatggatgataccgtttgctgccaatccgctcaactctttgccggttacacgtttcacggcttcaggactccagtaagtacgtacgtcggagaatatttgtgcacggttggtcaatagatgtccgaacagcatagctacgccgttgcaggcatcgttctcggtagctacgacaaatgcttcacggataccgttccagtcaaaagaagtattgagcagagcttccggatagtcaccgttaggatagaagtctgtccattggcgttgtccctggaaaccggctgcaatggcattgtgtcccaaggcttcttccttgaatcccatttctttcaatttgggatttccggtcatcaagtcgcgcatgataatcgtcatctttacaatgaattcccaatcagcatctttctgttcacgggttttacgtttttcaggacggttcttgaagtcttcaccttcgtttgtcttgcaatttttttcagtccaggccatggctttggcgtattcttcgtggtcatagatgccttcgtccattcgacggatgatttctgtgaggtctattgactcattacgcattcccaaatactcttggaagaaatcaggattaacgatagaaccggcgatacccatagatacactacccattgacaggtaagatttccctctcatcgtagctactgcctgtgcagcacgtgcaaagcgaagaatcttttccgatacatcttcagggattgtgttgtcgtccaaatcttgaacgtcgcgtccgtagataccgaatgcgggaaggcctttttgtgcgtgtccggcaagtacggcagcaaggtatacagctcccggacgttctgtaccgttaaatccccaaacagctttcggataatgaggattcatatccattgtttctgcgccgtagcaccaacaggaagtaacggtaatggtagaaccgaccccttctctttcaaacttctccgcacaagcagcgctttcggctacgcgtccgatcgtgctatcggcaatgacacactccaccggacttccatcaccgtttttcaggttgttgctgattagctcggctactgcttttgccaaattcattgttttttcttcaaggctttcgcgaacgccaccttggcgaccatcaattgtgggacgaatcccgattttcggatactttttcatggtttctatctattaaaggattaattaatatctgtgctgaactgtgctgatatattcgcaaaaaaaattaaagtgactttcgaagccttacttccgttggtaagaacttctgaaccggtacattattaagaacgaaattggccgcttcgtttcccatcatttcccaatcaatactcaatgaggttattccttcgtcaatcacttcgtaggaaggaatatcattatacgctaacagaccgaaatcttttccgcatttcagcccttccaatcttccttgtttcaccacttttactacatcttgttgcttgatggcgatataggcaactcccttacgtacgatcagattctcaatatcctcctgtatttcacagaggaatccttgctcctgacagaaacgggtaaaatacaccttactgctttggggatgtttcaggcttttgggaaacaaaaaaacgagctggtgatagttcttcaatctttccttgagcagattcaatgcctgatagaaagattcatcaaaatcctggcagatatatgaatacttttctttttcaaatttgccgaaatcgagaagtaataatcgtgaaggattaattttattaagaacagtgctgaatttctcgttatcgaaattcatcacgatgtatttgttgtattttccgatagattcccggaggatcgtattgaacaatcgttcgttgtattgatgaaacaataagtccaccttatagttaatgggcagatgtctgacgaaactattgtataaagcttctttgaaaggagtatattggtcgagcagtagtaagacattggtcacctggctcgtcacataatagcccttgccgggagtggagtcgatcagtcctcgttcgcgtaaatcaaggaaagccttgaaaacggtgtcgcgtgatactccgtattgagcactcaactgattgatggaaggcaaagaatctccttcaagaaattcttttctggaaatcgcctggctaagtgcgtccgctagttgcgtaaccttgcttgcctgttgtccgaatgttgcctttttatcaattcgtttcatattcgaaaaataaataacactatgctgaactatgctgatgcaaagaaaggcattttattctgaacggaataaataatttgatatgttttatagcagaaaacaataaaaaaatcccctccggcggaccggagaggatttatagcttttcctgatttcttgttcggaatctgctgaaatttattcagcagcagcttctgttgcaggagcttcttcagccggagctgcagcttcctctgcaggtgcttcagcagcagctttttcagcagcttcagcagctttcttttcagcgagtgcttttgctttcacttcgttgatcttcttttctgcttccagacgtgcttttgcttcagctttcttagcttcgtcttgtttagccttcaaagtagccaaacctgactgtttgttgtttttccaagcttcgaatttagcttcagcttctgcttctccgaatgcgccttttgctacaccgcccagaagatgtttcttcatgtaaactccttcacgagaaagaatgttacgtacagtgtcacttggttgtgcacctttcagtacccatgccaatgcagcgtcgaaattcaaatctactgtagcaggattggtgttagggttgtaagtaccaatcttctcaataaatttaccatcacgtggtgctctgctgtctgcaattacaattgaatagaacgcgtaacttttacgtccgtgtctctgcaatctgattctagttgccattttaaataattgtttttaatgattgatttgaattatgctattatctcgtaatagcgggcacaaagatacggcttttcttttgattgacaaacatttcgcatcttttttacgaataccgtttcggatagcggaacaaaattgctagcagggcgcatgctcccattgtaaacggatagtagagatttccgatgatactgatgggggagatactggcaagtcccgctgcaatcagcatctgcgctccgtatggaataatcccttgtatcaggcaggagaaagtatcgaggatactggctgtttttcttcggtcgagatggaatttcacggcaatatctttggcaatcggtcctgttgttataatggcaatcgtgttgttggctgtacataagttggtgatacttaccagggcggcaatgcttagttcggctcctcttttaccattgacgtggcgggtgagtttccggataatgaaatcgataccaccgttataacggatggtttcgagcatccctccggccaatagagtgataataatcagttctcccattcctgtaattcccgttcccatggcaccaaaccagtcgaaaattccaaagctgccggtcgcgatgccaatgatgccacttgtcaatatacctattatgagtacgagcatcacgttcattccggcgatggctgttcctaatactattatataaggtataactttgatccattcaatggtctgtgtttgggcgggagctgtaatggatagtccctgaaatatgtaaattcccaacacaatgatggctgccggtacgacaatcatagaatttacacggaatttatcgcgcattacacattcctgggtttttgtcgaagcgatggtggtgtcggagataaaagataagttgtctccgaaaaaagaaccgcctactacgacggctaccataaaggggagagctatttcagttttttctgctagtcctacggcaacgggagtaagggcgacgatagttcctacgctggttccgatggataaagagatgaaacaggcggcaatgaagatgcctgccagtaacaggttatccggcagaatatgcagtgtcagattgacagtggcatcgattgctcccatttgtttcgcactatgagcaaaggctccggcaagaatgaatatccatatcatcaggaggatatttttattggcagctcccacggagaactgatagatgcgttggtctagtttcaatcctttggtaatagcaatggcgtagcaggaagaaacaaggaaagccaccgtgataggcactttataaaagtcgttgacaagaatggaagttaccaggtaaaggcataagaatacgagcaacggacttaatgcccaccaacttccggtgcggtttttatgtattttttcttcagtcataaatggaatatgtagatattcgttttttgctttcggttctctgtctcttaaagtaaaataatacgcttttgcatgatttccgtcagttgtgctttcaacaggcgggcattgataggtttaggcatatagccgtcaaaaccgctttccatcacccgttgttcatccgaagcataggcaaaagccgtaatggcgataataggtaccttggcagaatatttgcgtatttctttagttgcctcgtaaccgtccatgaccggcatattgatgtccatcaatataatctgcggattatattgcttgaacatttccaccgcctcttgtccatcccaggcatgaattaattgatactctccctttagtatggatgcgaacagtttgtagttactttcattatcctcggcaatcagaatggtaaacttgtttttttctatacttatcggctgaatttcctctttttttatgctttcttctacggctattgcggctttatatggcagcgtgaaccagaatgttgaacctttgccctcttccgagtctactccgatggtacctcccatgtgttctaccagagtctggcagatagaaagtcccaggccggtgccttgttcgaaactatttaatttgacgaagcgtccgaaaatactcttttgcttgtccttgggaatgccacagccagtatcgctgacataaaaatagatctctttgccacggagttcatagccaaaacgaatgtatccttcagtggtgaatttgatggcattacttatcaggttgataagcaattgtgacagcctgttcttctctgtatggataaagcaattttcctctgccggatggcaggttagctgtactttttcagattttatttttaattgtaatgagctcgttaactcgttcagcattttgttcaagtctatgttggaatattgaaattccaatgttccggcttcaatctttgataaatcaagaatgtcactgattaattgcaataacaaggtattattgttttcaatgatgctcacatattcctgcttttcctcttcctcgtctgttgaagccaatatgccggagaaaccgacaatagcgttgaggggagtacggatttcatggctcatattggcgaggaaggcagacttcagacgattggattcttctgcccggtctctggctgtggtcaattccatttccatctttttccgtgtggtgatgactagtgaagaaccgaccagggtgagcggcttgccgttttcgtcacgggtctctacagcggcttgagcttccacccattcgattctgtgaatgttattctgtacattgataacccggtattcttccctgactttatccgatcgcccttctatcaggtcatcataggctttttctacccgtttacggtcttctttgaatatctttgagaaatattgggaatcgggcactgccaattgttcttcattcacgtctttatcgtttgtgctaagctcaataggcctattgatgtcgcaaagtatggttttgcttcgcaaatcccatttccagggcacgatattggctacgtccagtgccattgccagtttattgttggtagcacttagtttttgttgtgctttgtgtagttcggtgctgtccaggcagaaaatatcgacaatattgttgtggtgagttccttttagtactacatcatagaaggtgtctatctgtttgaaataataggggaaagtgatagccttgttttccgcaagtgacattttggtgaaatgcaggaactccggcatggattcagggaatatttcactggctttcttgcctactacatcttctttacggaagaaacttttctcgaaatgagcgttgacattccggtatacaagttctatcggagtgccttcttcattcatgattaactcttcttgcatatacaatataggcatattgttaatcaggtttttgtaagaagtcattgtgtcaatctctttctgttgtattttcttgagcttattcagatgactgatgcggtattggaagaatagggcaagcagtatgaagcagactatggttcctaaaataaagtatccgtactgttcccaaaacgtaggcggcttgttaaagaaaatagtgcccgggggacataagtatggcgacattcctttacgtagcaaaacattgtagttgatagtcggagcggcatctgaaggctcgtaaaaaggtatctcggatgcttgtttgccattcaatattgattggatcgtttgtatgattttctggctgtatgcatgttgatcgtagatgtatccgccaattattcctcctgcgttgtccttgattgtcatcatcccaaggctgaacagaggtgcggaagtcgttgagactaacaggtgtgaatttgtaactagcgaggtgttgccggcaaaggtgtgtttgtaaaaccatgaagagaaaagtattcctgttgttttaggatcaacggtgtaaagggtgtccagcaaatgattggtttgcatcttccggggcgatatgaattgataattgatgtcgggatggctctttttcaattcttgtttgataaccatattgtaagtctggttgttttgccgttcatcaccgataaatatgaaatttttaatatcgggagtcattcggcaaatcaggtctatattttctttaatatagaaattggaatgtaggaaagtgagattgtaaggctgcgccatatctgcaatcggggttcttgcagtcaactcaacaggcttcttttggagataaaattccttcgggccgatgtaatcttcttcagcacatagtataatcggaatatttccccacatctttctgaagtcgtcccgtaatatcatgctggagtttccgagtaatatcaacatacgtggggaatgctgcttgtatttttccagaactgtttgtctgaattcatttaaagtggagtctgtgtccatcattagcatgttcatgtgttcggtatagagtgctaattgaggcgaattctgggcatattcggtaatggctgaaatcattctgaagctccagggagctgcttctgtatatgaattaatgattaaaagataatttgacgagttcactgaatctttttgagctagaatcggtgatatgtaggaaaaagctaatagacagaaagacaaaaataattttattatatatgagttaattattttggtttgaaaaagagttgtcatttttaatttaattttctggtggcttattaagtttatgcattggcaaaagtattaataataaatgaattaaacttgattttgaccataaaaaatgaatgaaaaaaagacttcaggtctttttctgattaacgggctttttattcaattttatagggatacgcttttgtagggatgagtaaaccaaaaacgcgagccggttcccatctcggattccactccaatagtgccgccgagatgttcgataatgctcctgcaaatagacagccctaagcctgtgccttttgagaatgaattgagtttcacaaagcggtcgaatacccggtctactttgtccggttcaatccccattcctgtatcagctacggaaaattcaatttcactggtatcttctttcaggtgatattcgagaagaatctgtcccttatttgtaaatttgagggcattgttgataaagtttgtgataacctgcatcagacgtttcttgtcagtatagatatagaaattgggtagggtgggggctagtaaaactggtaccggcttatcttcttttatatcataattgcgtataatatcttcacagaagctcttaatgtccagataatccatggtgaagtcgagtgttccggcttctatttttgataagtcgagaatgtcggatatcagttgtaaaagaagttcggtgttttcttgcatgatatcgacataatcctgacgttcctttttgtcatccgattcgaccagtaaactggcaaagccgacaatcgcattgagcggagtacggatttcatgactcatattggcgaggaaggctgattttaagcggtccaggttttccgctttttctttggctatccttagttcttcttctattgttttttggtggtcaatatcaacgctggtaatcacgtgtgccatctgtccgtctatccaggcaaatgctgcactgaatacccggaaccaacatttgtcgaacgggcgttggtaatcccaggaatataccttggttggcagcccgttttcatctatcaaatgtttcttaggacaaaactcacattctccggttttatctttatatagagcctgccagcatttttttccttcaaagtgttcgatacctccataaggagcggccatagattcattggcatatagcatatcatgggaatcaaaagagtttacgtagatgtcaacccccatattattcatgatgctgcttaacgtcttgctcgcccgtacttctctttctttatattcccgcactgctatttccttggagagggagcctaaaatgagatgaatcatttgcagttcttcatcggtgaaagatattgcatgttctctgtctccaaatccgatgaatccgataatttttccttcggagtcttgaatttgccggattagtaatgaatcgactttatagaaatccacgatgtctacatcatcccaagaagtattttggtttctgcaagcataaaaaggtttgttctttccatttgcacggacaacatgttgattggtcatttcgctgatttcaaaacgttgtcgcaaaacgttgtcgttatttccgacagtttcctttagatagaagtagcgaaatccgtcagtttgataaatgaatcctcttttaaagccatagtattcgcaaatatccgtaagtgattctgtgatttttttctcaatagagtcacagctattcagtctttctaaaaaatgaagtaaaaatgcattgtaattctctctttctctaatcatattgttttaggcatcttgtttggttatttaaactcggaaggagtatgctgtttatctctttcaagtcttcaagctgctaatatacggacttttaaaaaatgatgaacgctgtttcagattttttgtaatgttccgtttttctttttcttggtacgaaaagagaatgtgatatatgatatttcccttggattttagttaactaacaataatcatttgagaaataaaggagtgaatacttgtacggatttattgaattgaataatgattggggaagttagtcggtcattgaattttttgaatctgtaagtgattgattattaatgcgccataaatgtacatttttcctttaaaaccaacgggtcgttcctttaaaagaaacgacccgttgtacaccgagaaacacactgttgcttttaaaggaacgtgctttttcatcttcggatgcgtagattaatataataatgtttatatttattgttttatatctacgttgcaaacattattttaatgcttcgataacctgtggcatcattgtccaaatggtgttttcatcttgagcagtaaaaaagttgccatctatctctgatttcttatcggtagctgttccgttttgaatagctggtttagctaatgggtgaactgctactttcttccctttggtaattccggtaaagtcaaacatcattgcaccggcacaatgtccgatcatcattttccctttatctccgaaagttttaatgacttgcatcaaatctacgttatagggtttatcggcattctgctgaaatacaggtactgcatccccacaagagaaaacgagtgcatcgaattcatcttcgtgtcccttcaaattagcgatcacatcgtctgctgtcaggctgattcctgaatttgttttaatctccttcgtatccgatacggcaaatactttatatgaaatgccattctcgaaaaacgcttccaaatattggaataatccacaaccatttaccggattcactgctaaaactgcaactttctttgccataatcataattatttaaatgaaacaatagttattattagtaagtttattacttttgtgatgcaaatgtatctttctagtttgagaaatgcaataacgtacttgaaaataaggaagttacatagaggtaactattgttggaactcaataaaatacaaaacgttaaagaatgaaaaactttcatccgataggaaattgtccgataagagatgtgcttagccgcttgggagacaagtggtcgatgctggtgcttattacgctgaacgcaaacggcaccatgcgttttagtgatattcataaaacgatagaagatgtttcacaaagaatgttgactgtaacattgcgtactctggaatcagatggattggttgaacggaaagtatatgctgaagtacctccccgtgtggagtattgtctgacagatacgggtggcactttgattcctcatattgaaggactggtgggatgggctttggagaatatggatactattttggaccatagacaaatgagtcggtaacatttttattttatgataaaatagataatatggagataaaactagtaacttcagataaaaaagaatttctcgaattattactcttggctgatgaacaggaaagtatgattgaccggtatttggagcgcggcgatatgttcgttctttatgataacggattgaaagctctttgtgtagtgactcgtgaaggggaaggtatttatgaaatcaagaatattgctaccgttcctttctttcaacggcaggggtatggaaaacgtttaatcgaatttttatttgaatattatcagggaaagtgttctgaaatgttagtgggtacaggcgatgtaccttcttccagatctttttatgaacactgtggttttgcgatttctcaccggataaagaatttctttactgacaactacgatcatccgatgtatgaggatggtgtgcagttggtggatatgatatatttgaagaaaacattttagtgtgtagtgagtgaaggaagttcaatcgtttggatgaaataaagaattttgtttgtttatgttactgtatgaatgaacggcttatttataacctcctattgtatgaaaacgtgtttgtcaatttttacaattaaagactacgttcttaataaacgtactttcggtttataataaactttttgatagtttattataaacggtatcagagtttattaaaaactattttgagtatttttagagattctatagaatgagttaagtaaaaatataaacaaaatagggcaatgatcgttagatcattgccctatgatatatctgtattaatactaaaatgtatcagtttaaaggtcctttatgtctctatttttcctagatttttcatttctcttattgcttttgttttctcaaagatacaaaataaaaagccatttgtcaagtgtttcagaagaaaagccgattattcattaaaccagtctattttctttgaaaaatacatcactattgccagaatgataaacagtcctaagctgcctgccaataatgcgaaagtctccagctggataagaacaaagatataaatatagagtatagccaataggccggacatgattaatgatggtttctttttcttggtaattccgaacatatagccgcctaccagtataatagtcagtgcagaagataacaaataggccgggttgaaaccgacgtgctcggagaaagagaggagcaggctgtagaatagacagagagctagtcctaccaataaatactgcaaggcatgaatacgggtcttgttcatgatttcagtgaagaagatcactccgaaagtcagtaggataatcagaatggcatactttgcggagcgcatggactgctggtactgttccaccggaattttgaaattcacaccgaaactggagttttcaatatctttgatgttcgaggtgttgtagtcagccatcacctgcgaataattccgattcaagtttaaaacctgccattgcgcggaaaattccttctccgtaatattccggttgttaggcagatagtttccggtaaagctcggtgtattccagttggctttcagatctacacgggttgttttacccaacggaataaagttgagtgactgtgaacctttcagtttgatttttatttcataagggagttttttattctgcttcaattccgacaaattagcgatcgcatgaactccggtattatctatgcctctgttgtccatacccggctcgaagatgtaaactgaatctcccaaagtgatgctgatttgttcgctgatgccacgcatatcggtcagattcaggcaaatagctgccctgtcaaactgcagctgttccatatctattctgctctttttcaattcttccgaactgaatgaccctttcaatgtcagttccgattgatatacattgacctcgtagatacttcttttcagaatttcagtctttagttgtccgctgaccataagctcatcgggaaaaagtatcaggtctttgatagaaaccttcttctcgccgttattttcaatgacgaccggatactggagattcaggtaggggcccgtgatggtctgtgccagactccatttttcacttacctcgtcgatagcttcttcctgggttcgtccccgttcggaaataagattttcaatcatgaacatcggtatcatcaggagaagaattaataatccgatgatgacaaccttgattgttttggagaaacggtggagacatcccataggttgctgcacctgttgctcatttgaattttcattgaaaccgtccataagccagtagtgttttgatgaattatttattttgattttagaaatttctctaaagcttcaatatgagatttgaaagcttctctgccttgcggggttgcttgaaaaacagttcgtggctttcgtccaacaaaacttttgttacatacgatatatcccagttcttccagggaacgggtatggctggcaagattgccgtctgtcagagagagctgctctttcagaaaattgaagtcggcttcctcatttaccatcagaatagccatgataccgagccggaccttgctttcgaatgctttattaatatattggaatgcttctatcatttatgatctctttctttcgtagtgtaaatagaacaatatgccataaagaatatggaaaccgccgaaaccgatggtccagaacagcagtgaatgaccttcccaaaaacaatctacgactcccaggcaaatgaaagcatatcctaaccatacgatactggagtaagtgaacttggatacgttgaccagtgctagtccgtaaaataaaagcatgacggaagccaggatgtcataatactcatgcatcatgatggagatgcataaaacacctccggtcagcatcggaagagaaaagttccacaatgcccggtaggtgaggcggctgaaaaatttctgtcctgtcttcttggatttataataggacaggatgcaggcggtgaccgcagctgctaccaatacgagcgaagctataataaccattagttcgagagcaacaattaaatgtgtgcccggggtaataacttgtgtagcgatgtatgcgccagctaatgcgtaaatgcccgccatgattgcagcgagaccacttagagagataaacttggacgacttttccatcaactcttttatctcatttaccgattctaatgctttatctttatccatataaaaagtactttgtgatacaaagtaaaataaaagatttcagatgaacaaactttttgcctgaatattttaatgataaatatttgaatggtatgataaggcgttaatatacagttgtttaatgggtgaatgaacgaatagtcagaaattatataaagagggtttgaaaatgaaattagtcaaacgtttgactaattcggaggaaatacctaactttgccgccgaaacgaaacaggtaaaaagagtatagaaaatgagagaaggagcagagtttagagaactcatgttgcagattgttcgtacccgtatggcttttcgccggtctatgcaacggacattgagaaaaaataatgcgggtattacgtttgagatgcttcaggtattaagtagtttatggcatgagcagggaattagtcagcagatattggcggaacgcattgcaaaagataaggcatgtctcaccaatttgatgaataatctggaaaagaaagggtatgttcatcggaaagaagatcttgccgaccgtcgtaataaactggtgttcctgactcccgaaggggaagaatttaaagaacagattcgtccgattctcgatcaggtttatgtatatgcagaaaaaattgttggtatagagagcattgaaactatgttgtctgaattaaagagtgtatgcgatgtacttgaaaatgtataagaagtatggggcggttttatctagcctgtttttggctgctcaatccataaatgcacaaacggattctttgtttctcactatcgatcagctttttgaacggggggtacagcatagtctgcaacttcaggcggatgtaatgaaagaatctatggcgcaggagcggatacggaccgcacggtctgcacagttaccggaactgcagatcggactgaaagggggatttgtagggcagcctgttgtttgggaacggggattatccgatccttcatatccggaagcaccggactggtcacaaaattatgcgattgatctggcacagcctctctatcagggtggtaaaatccgaagtgctattcataaagcggatatagaaaaacaagttgccgaactacaaacgttgaccgatgaggcggaaataaagttacggttactcaatcagtatatgaacttgtttagtctgtttaagcagcatgagatactgacacggaatattgaagagtcggaactccggttacgcgatatccggcgaatgaaaaaagaggggctgattaccaataatgatgtattgcggagcgaaatgcagctgactaatgaccgactgtctttggaggaagcggaaaatagcattgcgcttgtatcgcagcaactcaatatcttgttggggcaggatgagaacttgttattacaaccggatacaaccattctctatcaggcagttgctttgcagtcctatgatgactatattgttcaggcgtatgaaaatgatccggcgatgaggctgcttcgcgcacagacagaattggcaaggaatgaaatccgttctgcccaatccttatctcttcccagtgtgtcgctatatgcatcgaatacattggcacgtcccgtttcacgtacattggcggatatgtataacaataactggaatgtgggagtatcggtttcctatcctttatcttcactgtacaagaacaatcataaagtaaaagagagcaaactgatggtgtctttgcggaagaatgaagaagaacagaaaatgcagggaatccgcatggatgtacgttcggcatttttacgccacagggaagcgttgcagagggtagaggctctaaaactgtctgtccggcaagcggaagaaaattaccgtattatgcagaatcgttatctgaatcaactggctatcctgactgatttacttgatgcgaattccgtccgtttgaatgtggaattgcagttggtcactgcacgcactcgtgtgatttatacttattatcaacttcagaaggcttgtggacgtctttaataaacagaacagatatggcaattgaatggaaagaaaaacagaagaaactgaaaaaagtaagagttcgtaatatcgttttaaatttagtatgtgtctgtttggctgtctccggactttggtggactgctaattacttctggcgttatgtgaattacgaagtgactaatgatgcttttgtagatcaatatgtagctcctttgaatgtccgggcttcgggttatatcaaggaggttcgttttaaggaacatcaatatgtccatcagggagatactctgctggtgcttgacaatcgtgaatatcagattaaggtaaaggaagcggaagctgcattgttggatgcacatggctcgcaggatgttcttcattcgggtattgaaacttcccatacgaatattgccgtacaggatgccaacatcgctgaagcgaaagcgaaactttggcaattgaaacaggattatcatcgttttgaacgtttgttgaaagaagaatctgttccggaacagcagtatgagcaagcgaaagctgcttatgaggcagcaaaggcacgttatcaggcattagttgcacagaaacaggcggcattatcacaatatgcggagacaagtaagaaaacaaccggtacggaggctgccattttgcgtaaagaagcagacctggatttggctaagctgaatctgtcttatacggttctcactgctccttatgatggatatatgggtaggcgtacgcttgaacccggtcaatatgtgcagaccggacagactatttcttatttggtgcgtaacaaggacaagtggattaccgctaattataaagaaacgcagattgctaatatctatattggccagcaggtgcgtattaaagtagacgcagtgcccggaaagatttttcacggggaagtcactgcaatttccgaggcaaccgggtctaaatattccttggttcctacagataattctgccggcaattttgtaaaggtgcagcagcgaatccctgtgcgtatcgacttggaagatgtttctccggaagaaatggcacagttgagagccgggatgatggtggaaacagaagctttacgcaaatgattaccatgaaggaattggaggcacctgttcgtcaatgggtgcccgattggcttggacttatcagcattttcatcgtgattcttccggtcactatgctcaatggctcgtatacaggcagtatgctggaagtgtcgaacacgctgggtactaattcggaagatattacgatggggtattacgctgcttcggcaggtatggctatcgcatacccgattattcctaaggtgttggcagccttttccgtgaaatctctgttattgattgatttagtactgcaattcttcttgagttgggtttgtgcacgtacgcaaaacgcagatattttgattgtctgtagttttgctgtcggtttcttgaaagggtttcttatgttgtggtttattcgttatgcccagaagattttcagtccgaagaatgtgcgtagcgagttctattcttatttttatccgttggtttacggtgggggacaagcttcgatgctggtaacggctttactggcgtatcattataactggaagtatatgtactactttatgatggtattgatcttgatttccattctgtttgttatcatctgtttccggcataatcgtcccataaaagctgtcgcatggtctgatctgcatatccgtgagatgtttgttatttcggccgggttgctgatgttgatgtacgttatcaattatggcaaagtgctcgattggatggcttccggtaagatatgtatttatattgtaatagcacctatgctgattgcgctgttcatctggtatcagagccgtttggagaatccttatgtaagtctggctcctttgttccaacccaaagcaattgtgggctatttttatatgatgctcgtgatgtttttcagtacatcaaccactttgctgactaactatctgactgttattctgaaagtagatactacgcatacctattctctttatatttatttgcttccgggatatgtagtcggcgcctttatttgtttttggtggtttcgctggcaacggtggcgtttccgttttctgatagcgggaggaatgagttgctttgtgattttctttgccattttgtattttggcatttctccggatagtacgtatgagatgctctacctgcctatcttctttcgtggtttgggtatgttgactttgattattgcttttgccctatttgccgtggaagacttgaatccgaaatacttattgtcgaatgctttcttcctgattattttccgttccgtgctggcacctatcatggcgacttctttttatagtaatgtactgtaccgactgcaacaaaaatatatgtattctttgtcggagactataactgctactgatccattgtcgtcaacacgctatagccagtcgctgaacaatgcgatgacacagggacatccgtatgatgaggctgcgcagttggcaaccaactccttatataatacgttacaacaacaaagcctgttgctggcactgaaagagattctgggttatttgttggttatatctgttgtcatagctgtgatttctcgttttattcctttccataaaacaatccgcgttacgtttaagaaaacaggcgatgatatggtataacaaaaaaagagttgctatccttcactcaatgataagttgaacgggatagcaactctattgttttaacaatgtatcttttatcttcgatatatttgttgtatcagatagcgacctgtttacaaggttacccctgttttaaagatagcaatttcgcgatagcctttcttttcgttgtttacgaattcaccgcttgccactttgatgatataatcaatgaagcgttcacaagtcttttccatcggttcgttttctacgatcacaccggcgttgaagtcaatccatcccggtttgtttttagccagggttgaattggtggaaatcttcatggtcggaacaaaagtgccgaaaggagtaccgcgtccggtggtgaaaagtaccatgtgacatccacttgctgcaagagtagtggctgcaaccaggtcattgcccggagcagaaagcaggttgagtccttttttctgtaaacgttcgccgtaaggcatcacgccggatacatagctctttccgcacttttgggtacatcccagtgctttttcttccagggtagagataccgccggctttgtttcccggagaaggattttcgccgacaggctctccgtgtgacaggaagtattctttgaagtcattaatcagatggacggtctgttcaaacagttcctcgtttttgcaacggttcattaggatggtttctgcaccgaacatttccggtacttcggtcaatacgcttgtacctccctgtgcaatcaggaaatcggagaacatacccaatagcgggtttgccgtaatgccggagaaaccatcagaaccaccgcatttcaatcccacacgcagttcggacaaaggaacatcggtacgttcgtctttagaagcctttgcatacaaatcgcgcaggatttccattccttcttcatattcgtcacctaccttttgagtaaccatgaacttcacgcggtcctcatcaaactcgcccagaaactcacggaacacgtccggctggttattttcgcatcctaagcctactaccaatacggcacccgcattggggtgaagcaccatgtcacgaagaatcttttttgtattttcgtggtcgtcaccaagttgcgagcaaccgtagttgtgtgggaaagcaacaatggcatccactcccttgccttcggtttcgcgacgcagtccttcagccagttgaccgatgataccgtttacgcaacctaccgtcgggataatccatatttcgtttcttacccctacatcaccgtttttgcgacgataacctttgaatgtaagatctttatgaggaatatccaaagaaacctgaatcgggttgtaagtgtaatccaacaatccggcgaggttggttttgatgttcgtttcgttcatccagtcaccctgtttcttagccattcgtgcatgtccgataggataaccgtacttgattacattttcgccttcagcaaaattcttcaatgcgaatttatgtccggcaggaatgtcttcgttcaatgtaatttcaatgccatctacagaaagatgctctcctgccgggaggttaacaatggcaacggcgacgttgtcggcaggattaattcttaaatactttgtttccatgtaatgtacttgtaaagttgtactttgttgttatttgctatggtaatagtctattgtctctactgttaacagatcaatgggcatatagttgatacgagtcacttctttcttgaaaataagatgatcgcatagagctttgatgccattggctccttgcagttccggctgctgggcgatgaggaaggagatacttccttctttcaggcaggtgacattccgttccagaaggtcatagcctatcagattgaagtctttctttccacggctttgcaggtactcgccaacgatgtaggctttagagttgaaagtgattccgttcttaaccatcggataagtgcggaagaattcgtccagcatctcgttatcttcgtcgttgcgttcggcatgcaagtcaagttccagtatagtacaagacggatgatgttctttcatgtactgcctaaaaccgatttctctgttctcctgctgattagatcctacaattccttcatgtattttgcggaaaatcacaatttccttttcctcccgtgccagtaacatcatcattcgagcagcgaaatatccgctttgacgtgagttctggccaaagaaggcaaggggaggaacctctttaatattggagtctatatatatataaggtatatccagtgcctgcaactgatcggtgaatcctttcgtatattgcggagcggtaggagctaccatcactccgtccggctgcagggccaggatggcttcactgacgttgacgaatgaatgataatcgtatggatcgtaatagttgattttcaccgaagtattgaaatccgaataggtcgcgatagcttcatgaataccgatttctacagccgtccagtattcgccttccagatgctccggcaaaaggcagataaacgtatacttcttgttggaagccagagcgctggcgtacatattgggctggtagtcaagctgcttcagaatttcttctacgcgtttcttactggcctccgacactccgctacgtccgtgaataacgcggtctactgttcccactgatacatctgctagacgggcgatgtctttgattctgatcctttcgggcaatttattcatacgataacctttatttatataggtttttgtgctcgcacacaataataatcttaatattttcgatacaaatatataacaatttttgtaattacgaaaattgttgtatctttgtgcccgcacacgaaaggtatgtaatattagttgtgttatagattaatgttcatataatcaatgtgttaacccttgaagtggggctggaatgataaattgaaagttcataatattaataacttagaaattgaaacataagattatgggaaagaaagtcgttacattaggcgaaatcatgcttagattatcaactccgggtaatactcgttttgttcaatctgattcttttgatgtagtatatggtggtggagaagctaacgttgcagtaagctgtgccaactacggacatgaggcctatttcgtaactaaattgccgaaacatgaaattggacagtctgctgttaacgcattgcgtaaatatggtgttaagacagactttattgctcgtggtggcgaccgtgtaggtatctactacttggaaactggtgcttctatgcgtcctagcaaggttatttatgaccgtgctcactctgctattgctgaagctgacgctgctgatttcgattttgatgcaatcatggaaggtgctgactggttccactggtctggtatcactccggctatctctgacaaggctgccgagttgactcgtctggcttgtgaagctgcaaaacgtcacggtgtaactgtttctgttgacttgaacttccgtaagaaactgtggactaaagaaaaagcacagtctatcatgaaaccgttgatgcagtttgtagacgtatgtatcggtaacgaagaagatgcagaactttgtttgggcttcaagccggatgctgacgttgaggctggtcacacagatgctgaaggttacaaaggtatctttcagcagatgatgaaagaattcggattcaaatatgtagtttctactttgcgcgaatctttctctgctactcacaacggttggaaagcgatgatctacaacggagaagaattctatacttcaaagcgttatgatatcgatccgattatcgaccgtgtaggtggtggtgactctttctccggcggtattatccatggtttgatgactaaacctaatcagggtgctgctcttgaattcgctgttgctgcatctgcattgaaacatactatcaatggtgacttcaaccttgtttctgtagaagaagtagaagcattggctggtggtgacgcaagcggtcgcgtacagagataatttggagagttgaaaagtaaagaaaatcaattcatttaaatagtaaataataagatggcaaaattcgataaaatagccgtattgaataagatcggctctacaggaatggttcctgtattctatcacaaagatgcagaagttgcaaagaaagtagtaaaggcttgttatgacggtggtgttcgtgctttcgaattcacaaaccgtggtgactttgcacaggaagtatttgctgaaatcgttaaattcgcagcaaaagaatgccctgaaatggcaatcggtatcggttctatcgttgatccggctactgctgctatgtacctgcaactgggtgctaacttcgtggtaggtccgttgttcaaccctgaaattgctaaggtatgtaaccgtcgctcggtagcttatactccgggatgtggttctgtgtcagaagttggttttgcgcaggaagtaggttgcgatctttgcaaagtattcccgggtgatgtttacggaactaacttcgtgaaaggtttgatggctccgatgccatggtctaagctgatggtaacaggtggggtagaacctactaaggaaaacctgactgcatggattaaagccggtgtattctgcgtaggtatgggctctaaactgttcccgaaagataaggtagcagcagaagactgggcttatgtaactgcaaaatgtgaagaagctctcggctatattgctgaagctcgtaaataagattagagagcgaaagctatctataataaaaagaggttgatgcgacagtctcttttaaaatatgcctcgagggttagttagtttagttagtatatgaggcatattttcattttgtttaaaggtgtttaaaggggacaggccatcggaatgagtgactcatttcggtggcttgtttttttatttcctttttatatgttgtcgatgttcgaatatataaatgggcaggaatattaacaagaagcagagaacactgatgaggagcagataacggttgtagagatactctccctcctggggaggagcacttaacaggcatcttaagcaatcgcagtccatatcctgactgtcgtgctggcaaagcaaaaagcagaaagtaatgagaacgatacctaataacaggcagatgattagtagatttctgcgataatgtgtgtgtcttttgtcgggttttgataaagaagaaaccatgttttgttctgatagttatcaatgtaaaatgaaagaaataaagggcagacaatgcctgaataggattgtcctgcccgatactattgattattggtaggaaatatacttttaatggttattccggaacataaataatctcaccgttatccagttcgtaggctatccctacttttcttcctcttttccctgaatcctcctctttctgaccggaaggcttgtaagtgttgattttctttccttccttggagatgatttccatattttctttaccaggattcttcacgatggtgaaatcttcctgtccgaaaacttccgtcatattcatgtgcatcaccattgctaccatcaatgccacggcaaataccatcgctacgtcgaacaagtttactactacacttagcgggtcggtatcctcttctttgaggaatttgctgactcttctatttcttttcattattggactctccggttgtttcgtttaatactcttgatacataatcgaggttgttgacatctttggcataccaacgttgtttgaactgcatggatatcagtcccacagcactaataaccaaacctacaacagtcgttgcaaatactacctgcatattatatgccattccggagatatctcctgtagaaagtcccacaagtgccggactcatggaaatcaatgttcctatcaatccgagaaccggacctatcttagccagcattttagaaagagacacatctttctctgcttcattctcgaattttgttatcaggaagtcagagtaatctgcactggccggatggtagagcagatcgcggagataacccatatatagtgaattgtctttgtcgggtaaagctgctttcagatcgtctatccgtgcatctttaatgagttggtccagtgctttgtcatttttacgtttggtcatgtacatgttgtaggtgcctccgatcaaaataagtgaacgaacgaacaggcacagcaaaataatgatatcgggtataagtaaactgttcgctacccagaataaaagtttagagatgagttccatataatattttattgattgattttacttcttttttttaattctttacgttgtaataaaggccatttcagcttgttccaggcaaatccaatgagaaacaggataacgaacagaccgatggacaagataatcgctttccagttgagcgcctcttcggtggcggcataggtcgttttcccattgacagtggtcagtagtccgaggatacagatgaataagctgacaaggaaatgaacttccaaccggagatcgtcttcgggtacaagatacttcatcagccggcttaataatgggatggcgataaccactatccctgcaaatgaccaggctgtcactgaaaagtctacgccaggtaaccggaagatagcttctgtgagatagtagaataatacggggaagagcaacaagctgggataccagcgaagtaattccgcccaccataaattcttcttaccataaagtccgcgcaggaaagccacgcaatagccgaagcagagtgctgactcaagcgttatgataatagccatgttttgcaatgcttccgtgttctgcagataatcagcaatctgtgtctttgactggagaatagcatactgccaggtgccggctacaaaaagaccggctatcaggctgtatattacggtttgccaaagtttccagaaactgagtttgaaactgcagttaatcacgataaacagcattaatatgtgaataattaactccatattacattactttttccgtttctttttaagtattagcaacatgacaacaaatgctaccagaacaatacctgcgataaggcctccattcaaagaattttgttcttcctgtgccccttgtacggcatcgctcgattgtttcttcaataccatgcctcctttggtcgcttctccgtccagggtggcttgtttcatttgtttcagttccttgttgtagttggctgcggtttgcgcatctacttgagaggcgatgaactgctgtaatttggcattgtctccggtaaatccgctgcccgaaggaccgaattgtctgacaaggtctgtatgcagtttggcaatattggagagttgttccggagaagctttccaatatcctttgcgggcagtttccatcataacggcagtcacttcctgtaaagctgcgggattctgtttttcaaagaagtcttttacattcagtttgtattcgtctttgacatatacatcatatatattatcccaaagttccttgtcgatagcggcaggtttcatcacgttccagccatacgtattggttacagtctgggcaacttcgcttgctgcagaagcaccgcctttcattttctctttgatataggtaggattcagaatcgttgtacggctttctacaccgactgcttctttaagttcctgcattttcatgttgttgcggttccggtagtcgctaagataagcgtccgggtctttaccggtaacattgcgtacggcaagattcatacctcccatgaattcatatacgtggtcgaggctcaatgctccccaagtgttactttggcggggctgaacgacaacatcagtactgttcaatgctgcttcaaaggcaaatttctgaaagacttcccagtgtttttcgtcaccgtagaaggctcccatattgttgaggtaagtatctgcaatttccgattcactttcccagcggtcgccggattccaccattccttgaattcctgtaccatacatgccattagcacctccgaatactcggaaagaagccatttcgcgggcatctttcggactgacacctttttcggtcaacactctttcagcttctaccacactggcagctacctgattttcaaacttgtcgtctttcgctgccgcagccatttctactgcacggttaatcaggaagaggcgggaagcggcgatatcacggagttgtccggaagtctgaactactacgtcgatacgtggacgtcccagttcggctgaaggaatcagttttagatcactgacacgaccgaatgcgtcacgaacaggttctactcccagcatatacagtacttgagcaatagtagccccaccggtttctataaattcggaagaccagagagtataactcactttacgtgggattgaatcattgtgacgttgcttgtaagtatcaatcgtttgtttggctaaagcgatacctttttcccaagcggattctgtaggagttgcttcggcattgatagcatacatattacgtccggttggtaaagcattcggattagcaatcggatcacctccgggagtaggagcggtgtatccacctttcaatgcattcatcagactgcttaactcttcttcgggacttgtcagaagtgcgttcttgtagttgcctacattcttgattgtacgctctacttcagcgatggcaagtgccagttcgatttcttctttactgtattctttcggagcttttcccatagcggccatcatggcagccataccttgaggcttttcttgctttccactgtttccctgtttgtcagaagatccggcagctttttctttattagctttcattccggcttccattttcttcaatgcttccggacttgctcccatagacttagccatttccattgctttttcaggatccatgttggcgcccattttcttcatggcctctttcatgctttcgggcatttgaccatgaggagaaccctctttggagacagatgccggatgtcctttacctgctttcttttcgtcggattgttcactctttgccgatgcagccatcatcattgccatcatacctttcggagcattgcggtctgcctctatttgacgagccttggctagttcctgtgcggtgataccggctgtacgacaaatcagttcatctgtggccagtgcaggattagcgagcaacttttctaccagatggcgagcaggagtcaagtactgttgtgtaaagaggctgcggtgcttgctaacggcatctgtcgctttaccacgttgcttgtcaagagccagcaggctgtatgcgataggttctgtagccattgcatagacggaagaagtgatccgttccgcttcataaggaactcccattgtgtagagttgtccggtgattttctcggtagccagttcttctgcgaagttttctacacgggcgatttcatcttccgtatatggtttgttggcaatgctgtccaaacctaaatcacggtgaattcccattttcacagtcagcgttttgacagctaatgattcctgatctttattctctttgtgagagttattgtaaatcttgattttttccatcagctcccgataaataccacgcacactgctttcaaggaaaggaggagtgaggtacgactgtatggtggcatacgaacggcgtttagccatcattccttcaccaacattaccaatagagtagatatagaagtgcggaactgctccaaccaggcgatccggccagtcgttgctgcacaatgccacttgttttctgggagtaaattcaagacttccatgtgtaccgaaatggatcagtgcgtcagccttgaaaccatgttgcatccatagataggaagcaatataagtatgaggaggagccatattagtgccatgaatcacttggaaggagttgtccccgcttccggcagcattttgtggcattaagactacattcccgaattgcagacgggcaatacccaatttaccgtcgttagtcgccatatagttgccggggaattcgccgaaagcatccaccacttcctgatatttttcagggcggagtgactctttcacccaactttcatattgatctttggtgataagttcgggatgtcctttttgcataaagtcattaaaggctccctctgcgtaagagttgaacacagcgccttgagcctgtatcattttacccagtttttcagcatttgcaggcagaccggatatgttgtatccttcctgtttcatgcggaccagaagattgtatagggaaggaaccacctccataccggcagcggtcaatgcattttgccccggacctttataatagtagatagctaccttcttctcgctgttcggcttagtattcagattcaaataattattgattgtggatacgaaagtcttcaagcgttcgggtactgcatacgaatggcgcaatccttcttcatcctcatattgtgcaaagagagcgaaaggacggatggcaccgtcgatttccggagtcacgatactttgtgacataaatcctcctgccattcccatcggatctttctcccattcgtctaccaggctgttgatggtgagcggagcaaacaagaggatattcttagctttcagataatccaccattttgtctcccatgcgtccgtgtgccatgttgatgattgcgtctggctgcacttcgtcaataaatgacatgaatttcgtcattgactgaaccggataaacattgtaaccttctttttcaagagcctcaataagtccggtggcatcagccatttgtccggttatcatgattttacgtgctccttctttataaagacggttgtccttcatgaatttctcataatttgccacggtgaggaactccagttcatcatccgggttggtgagtccggcgtgatagagcatgtcgctgggtctttctgccgggtcttccacttccggtatggaagagattttaccgtcaatagctttacggatataattcagcatattccggtagttggtctttcctccgttggtcagataacctcgtatcagattctgttgtacgctgtccagattacaaatgttgttggccgggttggtagccatggaagtatatacaggaatacctttgtcggcagcctgttgtatttgttgacgttgttcctcgacgatacgcagacccattccgttgatgaataccatgtcgtaaccggtcagacggtcgaggttgtcgagcgatacttcactgagtttgatggataaattgtcgttggctttcgatatacttccctgctgtatggtctggaagttgatgaaagcaatctttgtaggactgaaccagatattccatacggacatccctatcagagctgcagcaacggtgcatacacctaagatgattttacttttctttttcatttctcttatttttagctttgtatgtagttttatcttttctattttctgaagaacctgtctacgtctaatgcaagtccgatggagaagttggttccccgggtataaggagagtttgcatcataatagcttggaacataattaaatatgttgttgacggccatattcaggctgactcctttccagatcccttgtgtcaacgtcaggttccacatcgtatatcccggataagtcactccggtagtcccttcatccggattattgcccacatatttattggtttctactttggataacgcacgtccgttcagggaaagattgaattgataattatcccatgatttgccgtattcgatacgtgcggtcgctgaatgtgggcgggtactggagaatttcatttgtccgtcgcgcataaactcgtggaggtatccgtaagaaacacgtattcccagaccacaaggatatttggcggaggcgttgatatccacaccggcgatgtctactttctctgtattgatatatagctgtgcccatcttccgtcagtgtcgcggaatgaagtcaggtcgatccggtcattgacaaggttgtaatatcctgaaacggtaaaattgtaacggttcttggtatattccgccgagagcgagaagttgtggctcgtctccgatttcaggtcgggattaccataaatcatcatggcatttgccatgtcgaagttcatatacatttctttgagggtaggagagcggaatccctgtgagtatgagctacggagggagcagttggctattttgtacatcagtccgatgtgcggagatatatgacgtacgttagattgtgagaaatagtcgaaacgtaccccgctgattacgttgaaatgttcggtcgggttccagtcgaactgtccgaatgcatctgccgagtgcatggtataacttccattgttggtaaattgataagacaatagatagtcacgcatataatctcctcctacggtcagaatgtttttatcgttgaaggtgtaattgtagagtgcgcgtacgctatgttgcacattgctgtaatcgcggacatcgtatttgtatgaggtcagataatcacttttatcatattggtcgaatgtataggcaacttccagattactcatgatgttgaaatcatagttggctttcagacctccgctgaaatcacgataacggtctttgctgtctccggtcttatcccgttcgcggaaataataacctccgcgtgcagtcagtttcaactgttcaatcggtctgtaaacaagacgttccttcacattccatgtgcggtttccgaagatggttgtcacatctccttccggtacgtcgtaagaatcggacattgtatgttgcacattcgtctggctgttgaatttaccggctttgaaactgaaagttccgccatatcgttggtcgttatgttcaccgaagcggctgtttacatttaaattccatgggtcctcggaatcacgggtgatgatgttgattacgccacctactgcactggaaccatagagagtagaggcagccccttttacaatttctacccgttccacgttatcgaggttcaatcggttgtagtcgacgttgtttaaagtttcccctgccagacgttcgccatctaccaggaagagtacagagtttcctccgaatccctgcatattgatagaaacctgctgatccattgaataggaaaattcaatgcccggcagttccgattgtaataattgtcctacgttggttgcatctaccttcttaatatcgtctgctgtgattacacgagtgatgataggagcatctttcagtaatttgggagtacgtgtacctgtgacaaccactgttcccaggtcaaactgatcttccgataagcggaaacttagtcttttctctttccctacagtcagtcttttttcttgtggctgatagcctacatacgaggcggtgatgaggtatgtaccggttccggggagttgtaatgtatatgtgccgtcgacggatgtgacggctccggttcctttacctttgatggaaatcgttgcaccggggagaggttccccttctgtatcagttacacgtccgctgatgtgataagttgagtgttgtgctaatgtggtgcaagttgctataaatgaaaaaagcaataatgatattataaatgtaggtttcattcttgttgattggtttcattgttgttgtcctcgaactcaagcggatactggaaattgaagtcaatatatccttttatacctctggcattcatgtagttggtaaaacggatcgctgcgtatgtattgtctttcaaacgtatcaaaaaaacttggtttgacatggtgtataccggaggcatcgttgcggtattaacgtccagccagctggaaagaacagcattacggtaagactctgtgtagataatgtttccgtccatcatgcccgacatgtcaatggctattttatcggttgtccattcatcttctacaaaatcttccgctttaggcagtttacctgttgctttaaactcgtcgatacttgtgtaagttgttttgtaggcagcaccctcgttggtttttatatcataacgatgaatagcgaaatcccacttgtcaggaatttgactctcatattcctctccgattttaacggtagtaaccgtacgttccgaaaggttaatgtaggcccattctgtatattcaacagtcttgacttgtgaaaagctattttccttgatttccatctccgtttcgatgggggcatcataaatattttcaaatattccattacaagcagagagcgacattgccgctcccagtactatagtatatttgaaaatagcgttcctgcttcttttcattgctatttaatcgtttattgtgcgctactttgagtattacttcccgtaaattctgctgtaattggcattggcatacttcccggtgagaaaacgatactaacagtggctgttccgtctgcattaattgtaccgttcagacttgtgccgttaatagcaagagcttcacctgtagttttttgggtatctgcttcaaaggcacccagactgagcgagtaactaccattgtttgctttagtaacattgactccggtaacagtgaatttttcaaagttactcattgaacctcctgcattattaaacccgctgattgtaacatttacggtactacctgttgggttttcaatctttacttggcaatctgtagtagagccaacttctcctccttgtaccttaaggctcaaattagtttggtatttataagtatcttttatataataaccaacaggagtttctccttgtatgaaatcaatctccatttttcccataggtacaggaatatcaacattggctttcaaacttaacactttagaaccatctacactaccttctaatgtgtagtcgtagctaccgcctgtgctgccgcccatagacatggcaacttcaccggaaccgctgaaagacttattagaagaaagttttaaattattcagagtgaaatctccagatccggatttatataccaaattgatggtaccatcttcgttggcagtgattgttgctgtggattcatcacccaacaaataatcagagaacatattgcatgcgccgactgaataacctttataagctcctgctatttctttggcaaggttaggttcatcgtcgtcgttgtcgctacaagaaacgaaagtagaagaaagagatagtgccataagggcaaccatccaaaagtttaagattttcatacttaattttgatagataatgattaattaaatttccagctgcaaagttacggggatatatatacgggggaaatacctaaaagaaatgaaaaaatgagaggctttaattatatgtaggtattgggaggagtggattaactcgttatttttgcagtcttttactaaattgatgattaaaaaattaaaatgagaagaaaatgaaaggcggctacagtagaaaaagtgtattgacagggattacttctttcctgattgtattgtttactatgccgttggggcatgcattaatgatttttatggagcatgtgctctcatccacagctcttcactatgcggctttcacgatgggagcagtaggtctggtgatggtgattattggagtgtttgcaaaaggagatacacgacagacattatggggattattcggaggactactcttctggaccggatgggtagagtttatctacgtatattatgcacatcgttatgaagtgcaaccattgctgaacgctgccggtgaagtcgtgacaaaaccggaatatttaatcatgccttcctccttcggcttttgggtgatgtttatgctgatttacattttcagtataaaaagcggatgcgacttctttacctatcttcaaaaagtctttttccgtaagagtaccaccacgattgtagtacggccgatgacacgtcatacctcgattgttacttttatggagttaaatctcatcatgtggacgagctatctcgtgctactcttctgttatgatgagaattttgtcggcgagcatagccctgttactgctatagttgctttcggctgtctggcaggttcattttttatgtttaaacgcctgttgaaaatcgctcaatggggatatgccatgcgcttttctattgctacggtagtagtgttctggacttttgtagaagtattgggacgctggaatatctttcatgaaatatgggtagaaccaatggcatatacaacagagatgattacgatacttttggctttcttagctctgttggcctttctattttatcagtctgctaaaaaaaagaatagtcataactaaaatatagaatcagaaattatgttagaaaaaggattgcaatttataaaggaagtagtggtcaaaccggaaaatctggcagtggcaatgggatcgggtgatctccctgttcttgctactcccgctatggtagcattcatggaaaatgcagctttgtctgctgttgaagatcaactgccggaaggcaatacaacggtaggagcaatgattcagactacacatcttaaacccactgcattgggagacacggttcttgtaacagccacacttcttgaggtagagggacgaaagttaacattttccgtagtagcctctgattcacagggtaaaattggtgaaggaacacatatacgttatgtggtagaccggaataagtttatggaaaaactaaccagtcgttaatactgccaaaagtggaaaaggatgaactaatctccgggtaagatgttttttgtatattagatataataacaatatataatatggaacctcatcatcaccacgaacatagtcatcggttgacatcgctcaataaagcttttatcataggcattgctctgaatataacttttgtcatagtagaattcggagtagggttttattataattctttggggttactttccgatgccgggcataatttgggtgatgtagccagtctggtacttgccatgttggccttccggttggagaaagttcaccctaatagtcgttacacgtatggatataagaagagtacgatacttgtttctttattaaatgcagttatactgttgattgctgttggcattattattgccgagagcatagacaaattatttcatccggtttcggttgatggttccgctatcgcatggacagctggggtgggagtggtcatcaatgcgcttactgcatggcttttcatgaaagataaagataaggatctgaatgtgaagggggcctacttgcacatggcagcagatacactggtatctgtcggtgtagttgcttccggtattattattacgtatacaggatggagcatcattgacccgattatcggacttggcattgctgttattattattgtctctacctggggattgcttcatgacagtctccggttgtctttggatggagtaccagtggggatagacgctcaaaagatacagcaacttatcgtggaacaacccggtgtggagaattgccatcacttgcatatttgggcgttaagcacaacggaaaccgctctgactgcccacgttgtcattgataatatcacacagttggaggaagtgaaacatcatataaaggaagcactcgaagaggcaggcattcatcatgccactttggagtttgaagacgaaagagctacttgcagcaacgaatgttgtgaggattaaataaaatccgtaccttcgcgcccttaaactaactaacctttatttttatgtttactgacttattgcattcctcttatttttcccttttcctgattgtcgcattagggtttatgctgggaagaataaaaatcagaggattatctctcgatgtgtcggcagttattttcattgcccttcttttcgggcattttggtgttatcattcctaaagaattaggaaacttcggtttggtgctcttcatttttaccatcggtattcaggcagggcccggattcttcgattctttccgcagtaaaggaaagacgcttattctcattactatgcttataatttgttccgcctgcctgaccgcagtcgggttgaagtacgcatttgatattgatacaccgagtattgtcggtctgattgccggtgcgttgaccagtacgccgggtctggcggttgctattgacagtaccaattctcctttggcatccattgcttacggtatcgcatatccgtttggagtaatcggcgtgattctgtttgtcaaactgttacctaaaattatgcgggtagatttgaataaagaagcccgtcgcctggagatagaacgtcgcggacaatttccagaactgactacttgtatctaccgtgtcaccaattcgcatgtgttcaaccgtaacctgatgcaaattaatgcacgcggtatgacgggcgctgttatttcccgtctgaagcacaatgatgaaatatctattcctacagcccatacagtgctgcgtgaaggagactacatacaagccgtaggtagcgaagaatcattgaatcagcttgctgtgttaatcggtaagagagaagaaggcgaactgcctttggataaaacgcaggaaatagaatctttactgttgaccaaaaaggacatgataaataaacaactgggtgatttgaacttacagaaaaattttggttgtacagtgactcgtgtccgtcgaagcggtattgatttgtctccatctccagatctcgctttgaagtttggtgataaattgatggttgtcggtgagaaagaaggacttaaaggagtagcccgcctgctgggtaacaatgcgaagaaactgtctgatacggatttcttccccattgcgatgggtattgtactgggagtgctgttcggcaaaataaatatatctttctctgatagtctgtcattctctccgggactgaccggcggagtgctgatggtagcccttgtgttgagtgcgattggtaagacaggccccatcatctggtctatgtccggacctgccaatcagttgttgcgccagttaggtctgcttctttttctagccgaagtaggaacttctgccggtaagaatctggtagccactttccaggaaagcggattgctgatgttcggagtaggagctgccatcacattgataccgatgcttgtagcagctattgtcggacgtctggtatttaaaatcagtctgctcgatttgctgggaacgataacgggaggtatgacgagtactccgggacttgcagctgccgattcaatggtggacagtaacataccgagcgtagcttacgcaactgtttatccgattgccatggtatttctgattctgtttattcaaatcatagcttcggcagtatattaacagaattttgtagattcattgattgttaaataaatagttcgtatctttgccgcctcaaagaaaaaatgaggtgaaacgattgttattgaatattacacgctacttcttaccgatactgtttgtgtcgtatctggtaagcttcacattctttgcccacgtgcatgtggtcaatggcgtgacaatcgtccattcacacccatttaagaaaggggcggcacataaacactctacagtcgaactgctactgattcattttctgtctcatttaacggcagacggtgcagccgtagtttttgctctttccctttttattcctttcttattgtatttgttgctcggccgttcgccgtatgctcactatcactgtccgtatcatggggtagtgggacttagagcacctccggctattcgtttctccattctttgaatgatgataccgtaccttgcatgaggtagggcattatctgtctatccatgtgagtacttatcgaaaactaataacaaacgaaaaatgaagaaatacatcttttcgcttgtctgcttgtgctgcgcattgttgcctgcccttgaaggacaagctcatgaatatcctaatcatcctgaattacgtaagtcagacgccaatatcgttggccatattcttgataaaaacaccaaagaacacttgccctatataacagtcgccttgaaaggtactaccatcggaacggtaaccgatgctaccgggcattatttcttgaagaatcttcccgaaggcaattttgtgctcgaagttagttcggtggggtataaaaccgtcagacggaatgtgacgctgaagaaagggcgcacattggaagaagatttcgagatagaagaagatgcagttgccttggatggcgtagtagtatctgccaatcgtaacgagactacccgtcgcctggctccgacactggtgaatgtggtggatctgaaaatctttgagaataccaattctacgactttggcacaaggattgagctttcagccgggtgtccgtgtagagtctaattgtcagaattgcggcttccagcaagtgcgtatcaatggactggatggcccttatacgcaaatcctgctcgattcccgtcctatttttagtgcactttccggtgtgtatggcatcgagcagattcctgccagcatgatagaacgtgtggaagtgatgcgtggaggcggatctgctttgttcggctcgtctgctattgccggaacaatcaatatcattaccaaagaaccgatgcgcaattccggtatgttatcgcataccattacaggtattggtgatggcgatgcttttgataacagtacggcgctgaatgcatcacttgtgacggacgaccagcgtgccggtttgtatatcttcggtcagaatcgccatcgttccgcgtatgaccatgatggtgacggatattctgaaattcccaagatacacggccaaaccatcggtttccgttcattcctgaaaacaacgacatattcgaaactaacttttgaatatcaccacatggaagaattccgtaggggaggagacttgttgaaccgtccacctcacgaagcgaatgtagcggaacagaccgaacactcgatcaatggtggaggactgaaatttgattatttctcacctaacgagaaacatcgtttcaatgtgtttgcatcagcgcagcatatcaatcgtgacagctattatggtggcggccaagatccgaatgcttacggaaacactaccgacttaaactggatggcaggatcgcaatatgtctatagtttcggaaaatgtattttcatgcctgctgacctgactgccggaatagaattcaatcaggataaactggaagacaatatgtggggataccaccgtacagtagaccaaaaagtgaatatcggtagtgctttctttcagaatgaatggaagaatgagcattggggatttctgattggcggtcgtttggataaacataacctgattgaccatgtgatattcagtccgcgtgccaatctgcgttataatccgacggaaaatatcaatcttcgtttcagctactcatccggtttccgtgctccgcaggctttcgacgaggatttgcatgtgaagaatgtaggcggtaatgtggcgatggttgaattggccgataatctgaaagaagaaagatcacagagcttgagtgcttcggcagatatttatcatcgttttggtgcgtttcaggttaactttttggtagaaggattttatacaaagttatcagatgtatttgcccttaccgacggagaggtagtggatggaatcctgacacgtacacgctacaatgcaccgggagcccgtgtgatgggactgacattggaaggaaagatggcgtatctgactaaattccaggttcaggcaggagtcaccctgcaacagagccattatagcgaaccgcatgtatggaacaaagaagctccggctgtaaagaaaatgatgcgtacaccgaatacttacggttattttacagcaacctataccccgataaaaccattatctatcgctctttccggtacatataccggttcgatgctggttccccacgaaccagttccgggattccttgaaaaaccgataacggtgaatacgaaggacttcttcgatatcggtttgaaggctgcctatgatttcaaactttacaagtcgatgaacttgcaggtaaatgccggtgtacagaatattttcaatgcctaccagaacgacttcgacaaaggggctgaccgtgactccggttatatctatggtccgtcattgccgagaagtttctttgccggagtgaagataagttattaaaattcggttaagatttaaaatcgttataaatagggattgttttgcatggagacaatccttatctttgcaaaaaacaaactaaaccttgacttaggtgcacagaataaatgtgcaagatgaccgaatgaaacaattgtacctacatataatgaagtggtttctgcctgtactgtttatctcgtacatggcaggaatcactttgtttactcactcccatgtggtcaacggggttacaattgtccattcacatccatttaaaaaaggcagcgaacatagccatacgacggttgaattccaactaattcatctcttgagtcatgtgttggtgaccgacagcggtttgataccaacattctctgttgctgctttatctctattatgcatcctgtttgtccgcccgcaaattgagcaattttaccgttcttgtccgggcgtaatatctcttagagcacctcctatcgcttagtctatctttttgggggaacagtattaatgtattaggatcaacgattaacgatcgctgcttccctttccctttattattatttttcgaattaaaacattaaaagactaacgacaatgaagaaatatcttttagtcctggtcggcctgtgctgtgtcttgtcatacgcattggctgaacgtccggactaccctgaactgaagaaatccgatgcgaatataataggtcatgtactggataaaaaaacgaaagaacatcttccgtacatcactatcgcactgaaaggaacgaccataggaaccgtgaccgatgctaccgggcattattttttgaagaatttgccggaaggaaattttatactggaagttagttcagtaggttacaagacagtgacccgcaacgtaactctgaaaaaaggaaagacactggaagaagattttgaaatagaagaggatgcgattgctctcgacggagtagtagtttccgccaaccggagtgaaacgacacgtcgtatggctcctactttggtgaatgttgtcgacctgaaactttttgaaaccaccaactcttccactttatcacaaggactgaacttccagcccggagtgcgtgtggagacaaattgccagaattgtggcttccagcaagtccgcatcaatggtctggacggaccatatacacaaattctgatagattcgcgtcccgtattcagcgccctttccggagtgtatggactggaacagattcctgccagtatgattgaacgtgtagaagtgatgcgtgggggaggctccgccttgttcggttcttcagctattgcaggaacgattaatataatcaccaaagagcctttacgtaattcgggtcagctgtcgcacaccataacttctttaggaggaagctcctcattcgataacaacacctcgctgaatgcttcattggtgacggacgatcatcgtgccggattgtatatctttggtcagaaccgttatcggtcgggatatgattatgacggagacggatttaccgaactgcccaaattgaagaatcagacagtgggtttccgctcttatctgaaaacaagtacttattccaaactgacctttgaatatcaccacatgcaggaattccgtcgtggaggggatatgttgaaccgtcctcctcacgaagcgcatattgcggagcagttgcaacattctattgatggtggaagtttgaaattcgattatttctctccggatgaaaagaaccgtctaagtgtttttgcatcggctgccaatacagaccgggacagttattacggaccgggtaacgatcctctgaaagcctatggaaagacaacggatttaaccgctatgggtggtgcacaatacgtacatacgtttgacaagtgcttttttatgccttctgatctcacggcagggcttgaatataaccgtgaccgcctaaaagataacatgtggggatataaccgtcacacggatcagacggtgaatatttacagtgcttttctgcagaacgaatggaagaacgaccgttgggggattctgattggtggtcgtctggataagcataatatggtggataatgtgatctttagtccccgtgccaacttgcgttttaatcctacccagaatattaacctgcgtttaagctattcttccggatttcgtgctccgcaggcttttgatgaggatatgcatattgaaaatgtgggcggaacggtggctatgatcgagcgtgcaaaggatttgaaagaagagaaatcccaaagtttcagtgtttctgcagatatgtatcatcgtttcggagcattccagacgaatttgttgattgagggtttttatacaagactgaccgatgtttttgtattgggcaaaccttacgaccgtggtgatggtatattagtgaaaacacgtagcaatggccccggtgctaaagtgatgggattgacactggaaggtaaagtggcttatctttctatcctgcaaatacaagcgggattaactttacaacgtagccggtacgatgaaccgcataagtggcatgacgatgcaccggcagaaaagaagattttccgtactcccgatacatacggttatttcactgctacttgtacccccatcaaacctttatctattgctttgtcaggaacctataccggcaggatgttggtgcaacgtatggatatcaccgccgagaatgccgaactgggtaaaatgcctgaaagaaaagcggaagcaatcagaacacctcgtttctttgatttgggagtgaaactggcttatgacttcaagttatacaaaacggttgatttgcaattaaacggcggagttcagaatatttttgagtcttatcagaaggactttgacagaggagctaaccgggattccggttatatttacggtccttctttgccgagaagtttctttgccggagtaaagatcagctattaatcggtcataaaaatagtttcccggcacggtactttttgtttcctgcgttgaaacactttgtttcaaatagtgaaacgatttgtttcacaccgggaaacactttgttccaagccttgaaactaaaagtttcaagcggctgaaactaatatgtcgtatagagacttgttcttttctccttgttaatcattgattgatcgggcggtgataggtgatagatgcggtgataggttgcaaacaacctgtcaccacccctgaaatccccatgaataagagcttttggaagtgtcggtgataggtgatagaggaaagtgaaagaaactctgtgtagagatggatcaaaccatatctttatcgaccccgaatttttctcctgtctgacatttaccggcaggttccacatgtaccagaatgtcatatacattatctaccgaattaatgatgctcttctccactgcatcggcaatctcatgggcttgcgtgatcgtgatttgtggattcacttctatatcaagggtaatcatatagagattccctatcattcgtgaccggacgcgatgcggattactggcaccgggcactttctctacagcctcgaatatcttattatatacattgacatctttcaccccgtccattagctccacattggaatcaatgaagatgctgatggaagatttgatgataaagagactgattatcaatcctgttatcgaatcgagtatcggcaatttgaagataaaagtaaatatcaatcctaacaaaacactggttgaaatgacaacatcattacgcatattgatagcgtttgccgtgagcatggaactgttgatcttctttccctgtttgtactggtatgaagccagtaagagtttaccgataatagaaaatatagtgacatagatggcgatagccgatggtatctctttcacttcatctgaaaagatgtttttagtggatgatagcaacatttgtacaccggcataaaatatcacgagtgatagaatctttgttgcgatcccttccgctttctcatatccgaatacatatttctttgaaggagggcggttgatgaggcgtgccgtaaaaatcataacgatagagataacgacgtcggttgccgagtcgataccgtcgccgactacggctaaactaccggcaaataaaccgattatgattttggatacggacaagattgcattgccaattgtgctgatccacgaggttgtgattagtattttctctcttgacattgaagtgactctttataattgtttgtaatgggattggggagcaaagataaacattaataggagtctgtgatatgaagtcgcaaaaaactttttctgcctttttagtagtttatacgttttagttgtattatatatagatggtcaattaaaaacaggacaattaatttattaaatagttaaccgcatgttcaaaaaactaagtagctcttttctcattgtgtcagcttgtattttttcttcttgcacgcctaccgtcaagcaagagattgcaatcttacctacccccgttagtctgaccgagcagtctggctcgtttgttttaaaagatggaatgaagattggggtttccgatcagtccttgtttccggctgccgggtatctgcaggagattcttcggaatgtcatatcgtcttctgttgaagtcactaccgataagagtcaggtagatatgtattttcagttgaaggatactgttggaaagcctagctcttataaacttgagtctacaccggagtatattcgggtagaggcaactgactattcgggtattatttctgctattactactattcgccagttgcttcctgcaacgatagaagtgcagggagagaaacagaattattctatccctgtcgtgcaaatagaagatgcgccacggtttgaatggcgtggatttatgttggatgcttcccgccatttctggaataaaaaagaagtgaagcatgtattagatctgatgtctttgtataaacttaataagttccactggcatctgtccgacgatcagggttggcgtatagagatcgagaaatacccgttgcttacagaaaaaggggcctggcgtaaattcaatacgcaggatcgtacctgtatggcacgtgcgaaagaagaagataataccgatttcctgattccggaagataagatacgcattgtggaaggagatacgctgtatggaggttattacactcatgatgatataaaagaaatagtagcctatgctacgcaaagaggtatcgatgtcattcccgagatcgatatgccgggacatttcctggcagctatcggtcaatatccggaattggtgtgtgacggattaatcgggtgggggaaaactttctcttctcctatctgtccgggcaaagatacaacgctggagttctgtcagaatgtgttcaaagaagtttttgaacttttcccttatgaatatgtgcacatgggtggtgatgaagtggaaaaagccaactggaagaaatgtcctctttgtcagaaacggattcgtacggagaaactgggttcggtagaagaacttcaggcatggtttgtacgtgacatggagaaattcttccttgccaacggaaagaaactcataggctgggatgaagtggtatccgacggattatcttccgatgctgccattacctggtggagaagttgggcgaaagatgcattgcctacggcaactgcacaaaagcagaaagtgattgcttgtccgaatgaatatttctatttcgattatgcgcaggatcagaattcagtaaagaaaatacttgcgtatgatccgtgtgcagacgagcggttatcgccggaacagaagaaatatatctggggtgtgcaggcgaatctctgggctgaatggattccgacaatgaagcgcattgaatatttgattgttccccgtatgatagcgttgagtgaaatagcttgggcggagccgacagctaaaccgggtctcgaagaattttatcgtcagcttgttccgcaatttaagcggatggatgtgatgagggtaaattatagggtgcctgatttgcagggattctataaagtgaatgcatttattgatgaaacaactgtggaattgacctgcccgttacccggtactgaaatacgttatacgacagacggcagtatgcctaccaaagaatcagctctttataacggtgctttggaagttgggaagactacggatttcgctttccgcacttttcgtccggatggttctccttcggatgcggtgcgtaccaagtatgtaaaggctccttatgcggaggcggtgactgctccggctgctttgcagcccggcttgaaagcagtatggcacgatttccgtggtaatctttgtgcggatattgatgcagctcctgtcaaaggggagtatgtggtggaatcggtatccattcccgaagaggtgaaaggaaatatcggtctggtattgaccggctatctggaagttcctgccgatggtatctatacatttgcccttctctcggacgacggtagcacattaatgcttgacggtgaattgttgggagataatgatggagcacattcgccggtagagattattgtgcagaaggctttgaaagccgggcttcatccgatagaggtacgttacttcgattgtaacggaggcgtattgcagatggaactggtgaatgaaaaaggtgaaaaagaagtattgccaagtgcatggctgaaacatgaatagcaaatttcattatttttaggtattgtccgtcttgccggcgagctgtacctttgcagaaaatatttgaaaacttatgcgaatcagtgagagacgagtcgagattaatcatatatcaaaggtgcacatgcaccggattgaatgggatgaagagagcttatagaaatataagctctcttttttttgaacgatttcgaatattgttcttttttgaaaacaagcgataagttaaatgattgtcgaacttaatatagattgaacgtacgttatgagtacattgaaaaaacttcagaactacatgggtaaacggaaagtgcttttgcctgcggcaatgctgctgtctgccctaagtgccctggcgggcatgttgccttatatccttatttggctgattgtgagagaactgcttgaacacggagagataacctcttccggtaatgtggtgacgtatgcctggtgggcggcaggcatggccgtggcgagcatcgtcctttattttgccgcattgatgtcttcgcatcttgcagcttttcgggttgaatcgaatttgcgtaaagaagccatgcgccagatagtgcgtatgcctctcggcttctttgacattaatacgagcggacgtattcgcaagattatagatgacaatgcaggggttacccatagttttctggcacatcagttgcccgaccttgcggctacttttctagtgccgttggtagctgccatactgatttttgtgttcgattggatactcggtctggcatgtatcgtccctgtaattattgccatgctggttatgggttttatgatgaatgcggagggacggcagtttatgaaaagctacatgacctctctggaggaaatgaataccgaagctgtagagtatgtgagaggaattcccgtagtgaaggttttccagcagactatttactctttcaaaaactttcaccgctgtatcatgaattataataaaatggtattcggctatacacgaatgtgggagaagccgatgtcgctctataccgtaataatcaatggttttgtgtttttccttgctccgttggctattttgctgattggttattcaggtaattatgcatcggtattacttaatttcttcctgtttgttctcattactcctgtattctcccaaagtatcatgaagagtatgtatctcaatcaggctttggggcaggcgagtgaagctatcggacgtcttgagaatctggttgcttatgagcacctgactgttgtagagcatccacaaccggtaaaggaattcagtattcagttcgaaaaagtttccttcagctatccgggagctaatcaaaaggcggtggatgatgttagtttcactattccgcaaggaaacacagtagctcttgtcggagcttcgggcggagggaaaacaacgattgcccgtctagttccccgtttctgggaggcaacggaagggaaagttttaataggtggcatcaatgtaagagaaatcgctcccgaagaactgatgaaatatatttctttcgtgttccagaatacaaagctgttcaagacttctctgctcgaaaatatcaaatatggtaatcccgacgcgacaatggaggaagtggaacgggcagtagatatggcacaatgccgggaaattatcaataaacttccgctcggactgaatacgaagattggtacggagggaacatatctctccggcggggaacagcaacggatcgtactggcacgtgcaatcctgaaaaatgctcccatcattgtactggatgaggcgactgcttttgccgaccccgaaaatgagcatctcatccagcaagccttgaaagaactgacaaaaggaaaaaccgtattgatgattgctcatcgtctttcaagcatcactgatgccgacaatatcctcgtcattgacaaggggaagattgcggaacaaggtacacatgccaacctgcttggaaaacaaggcatctattatcatatgtggaatgaataccagcaatctgttcgctggacaataggaaaggaggtttctaatgattgaagtaataaaaagacgttttgccctttcaactaaaggagcgaaagatttctgtaaaggtgtgtttttcactacactgctcgatattgtattgatgttgccggcggtatttgtttttctttttcttgaggaatatcttcgtcctgtgtttcagccttcggcttcggtgacgcatggtattctctattatagcatactcggtattgtctttatgatagtcatgtatatatttgcggtattgcaatatcgtagtacctataccaccgtttatgatgagagtgcaaaccggcgtatctcattggcggaaaaacttcgcaagttgcctctggctttctttggcgaaaagaatctttccgacctcaccgccacgattatggatgactgcactgatctcgagcatactttctcgcatgcggttccccagttgtttgcttccattatcagtattctgcttattaccgtcggcatggcattttataactggcagttgacgattgctttgttctgggtagtgccgcttgctgccgcaatccttcttttctcgaagaaggaaatacagaaaagcaatgaaagtaattatctgaacaagcggatggtgaccgagcatatccaggaaggactcgataccattcaggagataaaatcctacaatcaggagagagactatctggaaaaactggatgcgagcattgatacctatgaaaaggtattgactcgtaatgaactggtgctcggcatgttggtaaacggttcccagagtgtattgaaactcggactggcaagcgttattatcgttggtgccaatctcttggcttcgggtacggttgatttgtttacctatcttatatttatggttatcgggtcgcgtgtgtatgctccggtcagtgaggtgatgaataatattgccgctttgttctatttggatgtgcgtatcaatagaatgaatgagatggaagcattgccggtacaaaacgggactaccgaattcactcctcaaggttatgatatcgaattcagacaggtagactttgcttatgagcagggaaaacaaattctgaataacttgtcttttattgcccggcaaggtgaaaaaacggctttggttggtccttcaggtagtggcaagagtacggcggccaggttggcggcacgtttctgggatatccagtcgggaaagattaccctcggcgggcaggatatcagtcggattgatcctgaaactttgttgaaaaactattccgttgtctttcaggatgtagttcttttcaatgcttccattatggataatatccgtattggcaaacgggatgctacggatgaggaagtccggagagttgcccgcttggcacaatgtgatgagtttgtcactaaaatgccgcagggataccagacgattatcggtgagaatggagaaacattatccggcggtgagcgtcagcgtatttccattgcccgcgctttgttgaaggatgctccgattgttctgttggatgaggctacggcttcgcttgatgttgagaatgaaaccaagatacaggcaggtatatctgaattggtacgtaacaaaacggtgctgattattgcgcaccgtatgcgcaccgttgccaatgccgacaaaattgtagtattggagaatggaagtgttgctgaaatgggaacaccggaggaattgaaaaagaaaaatggtatatttgcccggatggtgaacagacaggttacaaatatgaattgataaatagcaacgatactatgcaatttttgaaaggagatatacaagagggaatcttgaaggcagccgaagaagtgtttctggaaaagggatacaaggatgcctctatgcgtgaaatagcttcgagggcaggggtgacggtgagtaatatctatcattatttcaccaataaggatgagatattccgtacgattctgaaaccggtattgaatgatctgtatgctatgatttataatcacgatgcagatcagatgacgatagacgtctttatggattcggattatcagaaaatgtctgtacgggaatatatcagattggtctctgaacatcgtgaccgtttgcggttgctgctttttcaggcacaaggttctgttttggagaacttccgttctgaatatacagatttgatgacgcgtacgatttctgttttttttcaaggaatgaagcagaaatatccgcatatcaatatagcaataactaacttctttattcacctgaatacggtatggttgtttgccctactcgaagagctggtgttgcatcctgtgaagaaagaagagatggagaagtttatagcggagtatatcgcttttgaaacggctggttggaaagagctcatgaatgcatgagctctctcactttattctcttactgatataaaaaaacgtccggctttcacaagccgaacgtccttgcctcttttagaatatgtcatctattcatattccaaaatgaatacattatatggtttttcaacttaacaaccaaataaaagaaatgcgggtgaatcacttcggccgatttctatgtatttttaatgtggctacgtaatataattatgactaattaatttaattctgatactgcaaagataggggctttccgcttttcccgcaatcccctaaaatgggtattcttctatcaattactagctatatatagtggttcaggcgtttgcataactatgcatccctccaagaacataatttaccccgaaataggtcattaagacggtcaggaaagcaagaatcatatagatatggaagaatagaggcttgcggaaaatgcgcagactttgtgaatggaaggctactccatataccagaaaagtaatcagtgcccatacttctttcgggtcccacgcccagtatcgtccccaggaaacgtttgcccaaactgctcccagaaagatgcctgctcctaaaaagaaggtggcagggtagagcagcaagcggctgactagcgtcaactgttctatccggttgtcttgtatagcgtcgtttccggagacattgttttccgattcttttttccggaggcataatgccagtattccgtttagcatgatgaatgccaatagggcataagacatcataatcaatgaaacatgaatacttagccatggagagacgagcaccggcattaatggggttatctggggattcatttgtcccagataggaaaccaacaaagcaaagccggagaggaggaatccgaatggaagtataaatgaaaatcttcgatggagcagacaggctatcaaaagaatacaaagagccataaactgcatggtttcgtaaccgttgctaagtggaatacgaccgccgatgtaccagcgcaggcaatatcctgctaaatggaatatgaaagcaagatagagtgcaacagaaaagaaagttcctgctgtgcgggaaatcgttttggctttgagcgagaggatatttctttgcaggctgttatgaagtagaagcaggaaagacaacactcccaatgacagatttatcataaaaagaatcttgctgaacggaatccggttgtagagtaattctgctttcacttccagttcggagagaggttgcacgctgccatcagtgggtaatggatggatgaatgttcctttttccaacatcaggatcaggcctactttttcatctgtttcctggattgctttggcgagtttgttttgttgtccttgttcacgttgccaatgttcacgaagacggtaaacagaaccgtcaaataaatcagttaatcgagcataaggtgtttgtaagtttaataaatgctgtaattctgtatttttgatgtatatcaatggctcatttctccacacttccggataaagtaaccagccacctatcacttgttcaggtgtcaatcctttatatgaagcttctcctgtcagtttctgaatgaaatcacgggctaatgtgttgaaaggtactacccggtcgtgataaataacctgttcctgtgctaaactgtccgcttgtgttcgtttcaatgcaggaaggagttttttttgtgcttgcatgttacctgcaaggcagaaaataaacagtataaatacacctccttttttaagtagcgggtggtttagcaggcgtcggaaatcactactgcgggaaaatagtagccaaatcatggagagaccgagcaggatatatcctgcataagtcactcctgttccccatggatcataattgacagtcagccagctcccttttccgtcatcatcgaaagatgactgatagaaacggaaaccttgtgatgtaaatatacgattcattgaaatctgttcgtgtaatagaacatttttctgtccgggaagagagtaggtgatatagctgatgtagtctgccggtgcttctgttccgggatagtatgctatacggaaactatctagttgtattgtgaatggcagatcagcttttctgccgctttccgattccaggaaactgtctatcgttgcccccggaagcaagtgtacgtatccttttttgcttccgataaacgtaatcatggcccccaccaagataacgaggagagagccatgaaacaacaatatggggaaccgtcgccataaagcgcgtcggatgagagcaacaagtgcaatggtggcaattgttccccacaaacaacaaaaccaacatgtatgatatatatttctttctacaaaatctgtcccatacgcttgttctacgaaagtagtcacagcgagtagtcccaccagacagatatataagataataagtaaccttttcaactgtataatcttttatgatattaaaatggagcgtattccttgttcttacattctttcactcccatacattccatctcaatcaaccatccgggacggcataccggagcatgaacaaatactttaggagtatgtgggaaacgtttgtcatacattgctttaacaactgtatagtcggctatgtcacgcagatatacaatcatttgtcccaaatcttcaaacgtgcagtccgcttctttcaacagggtttccacattctcccacattcgttctgtctgtttgcggatgttgccgggatataccacatcgcctttgttgttgatacttgccgttcctgaaataaatacctgtcggcggtctccataatctacatacgtgccacgttcaaagcttactccatattcataagttgggttcagatgggtaggagcatagaggaaatgaatctgttccggttgcattcctgctacagcgtaagtatccatttgtaccagtactttcgggtcggcatgccggccgtcgatgcctgtgctggaaatataatgtgttttttctgtcaggttttgggtgacgaaaacttcattacgtgctttcactactccggcataattcacatctacattttgcacgaaaaaccatgtacggatacaattgtctgccagtttacaaccttgttccatgagttgcatcacatagtcgttcaataatagacgggtctggtattccgaattggcggcacgattgaatgcactaccgccccagaagtggcgataggcactgtgtttcacctcaaaaagcccgttatgtaagacttgtgtctgtacatctgtcaacaggtaaacccataaggctatttttgttccgtccagcgggggctgttccacaatggaaagtgcgcagtccgaaccttcggttgtcaatgccagtagtgtatctgcctgattggcagcgtcactaaggaaataacgtttgaggatggcaactgctcctttcaattcttgggtaagtaaataatcgtaggtgtttaatactgcattcagctgttcttcgtatgtatcttccggtttagtagaatgaatgataatatgatactctgaagcttctcctcctgcattatatttaaaaatctctgttagcgtcttttcagactgaatattctgttgttttttgttgttcatatcagttgggtaaataactatttattcttgcgcaccgttattgatccagtcgtcaataagggtcaaaatcggagatgatactatttcttttgagtgatcgtatccccaggttgaactaatagtggtattcaataatgtgtgcaatacgctttcttgcgcactgcccggcttgacgagtaacatgccatctactttcttcgacgggcggttgaccagtgcctcgtaacttttgccttctgtcagatacaggttggctgctgccgaactacttccgccatgacagtgtgcgcatgtcgtattaaatactttttcttgaatgccatggtacatacctacatttacagttcccacatccataaggatggtgtcgtcaactgctgtaaggtcgtccattgactgaaaactgataactcgttttctcaatttattaataacgcacaattcaatagtggttactttatcactgactcctgtcatcgtaacctggatctcatcatcttcgaccgccggaattgttttggtgacaacggcatactcgctctcatcattgaagcctgccactacaacactataaccatcgggccatttactgataccattgatcttaccgctcatcttcagcgtgcgtccttcttctgatagggtctctgtcttttcgtaaatacgtccgtcatcgcatgatgtgatatatgccaataacagtagataacctccgaaaagaatgtattttttcataaacaaatcctttcttgtgctatttagaatgtatactgaagtagaatactggccgaatgtactgccaaacctaaatcgtcgttatcccgatcaagttgggtatcatgacctttacgggcaatatactggtacatcgcttgtaacttcagattacagttcttgaaaaaatagttcatacccacggctggcatatttagaaaaccattggtgtccattccgttacggttgaagaaatcatagcgtgcagctgcttgcagacggggggcaacgaagtaaccaccttgtacatagccgcccaggtaattatatgactcggaaatcttttgtctttttgtgaagccaacattcatataatagacttcagcacccaggtaaagtttgttctttagcattgcaaactccaatccggcacgataatcattggtactttcattttcactttctacattgatagaggtagaaataccaaacatgattttgtcttcattcagcctgttcggatttccctgtgtagcgggcatcactcctttaggcatataggtgaaacgtccggcgtacagtaaagacggaatgtgccagtcatcactaaatgtttttgttgctgtatttaccgctgcacccgtaccgttgaataaaccgatttcatacccgaatttatcagctaccaaaccgtgaatctctacacctaaatcgaatccggtgccaatattgggtgttaccgcattcaaagaataggggaggataacgggagcagtcagtgatactggcaaactaggtaacaatgtttctcccagtgttgtcaggtaggcatgtgaaaacggagttttgaatttaccgacccggatggcaaactgctttttcagttgaacatcaaaccaggcttgttgaagtaatgcgcctccactggctgccgcatttatggaaaggttgaaagatactttatcgaaagcctttccggtgaatccgagtacggcgtaaggaactgaaaatccggagttggctatgttatcttgattgtatgctttatccagtccttcatcgtcgtaccaattgaagtttgcactggtctgtacgagcagatagggtttgaatacaaaatctcctttcttggtttcgatagtgaatccttctcttccagctaatgatactacaccattttctgtatcttcttcatgttgtgccatagcggccaaaggcattatggcagtcagcatggcaatgattataaatctcttcataattactttatatatactacttttagtttaaagtgaatttaaaaatgcaatcagcgcatcccggtcttccttactcatattcttaaataagttctttgatgcttctccttctccgccatgccacatgatggcttctgtcagattgcgggcacgtccgtcatgcaagaaataagtatgtccgttgaccttttcttgtaagccgattccccaaagaggggtagtacgccattcgtttccacgtgccagcccgcttatatagttgtcgttcagtccgactcccataatttcagaacccatatcatgtaatagataatcagaataagggtgaatcgtttgaccgcctaaccacgggagttgagtattatttaataaaacactaccacgtgtcttagtgtgtaaagtggtcacatgacagagatgacatttggctttatagaagttctgttcccctttgattacttgcggatcgtttacattacgccgggcgggaacaccaagactttgcatatagagatctacgttttccatctcttctgtgctgacatccagttggtcgtaagaaagccccatcatgctaccttggtttacttgtatttgtccttcacagatttcttccggatagcggctgttggtaacgcccatatcactggagaatcccaattctacagttaaatcggcatgttgagctttgttgccggacaatcccagacttctcactccgcgttcggtgatgtaattacatcgtccgctgattccatattcgggataattactttttgctgcaagtgcttcaatttcaacaggatctagtgccatcatttgccccatgcctacatggcgtaatggaatacgtacggtacaaaacaaatcttccggtttgatttcttcggcataccattcagatatagtataattgggtttgcaaagtgtgtaggcttctccatcagggaaagaaaatgtctcgtaagtgtattccacagacagtttgccttccggttgcactccatagattgcctggtcatgaagcacacgtccataatcttgaaagaaagctccgtttttacgggatatgtagactagcatggaagagaatccatagctgcccgatccaccctctgtccataaagagggtttggtacgtcccgcattccggtggcaactgccgcacgaataaccggcataaacgggaccaagtccgccgccatgaccgttgttacttgtacgtacatcgtcatatagtctgtcacctcgggtgaaacgtacatcgtatgctcctgttatccaatctgcaggcgtgtcataagcaacagacgaattcaagaaaatagttgatgttccggctgatagagcatagccctccggaatctcgatatccaatatgtcaattccgtcatcattacaggcagagcatgccaacaggcaaaagaaagagaatgaatattttagaaagtgattcattgtttattgactttgtttcaataatatgttttaaacataccaaagaagtaaaggtggatcattgaattccaacctttacttctcaataatatcttagctaagataaagctttattgtactttacgtggttcaccgtttttgtagagaaggaattccaatgtgtggaaaccgcgtacattttgtgccgattcgacagcagcttcatcatcaccttcactccattcgagatcactccaactttgagaattcagtatttgtacaatagcattctgatccaaaggccagctgtccatgttaggatcaagtcccatttcgtctaccggaccgaataagaaagcttcgctcttttcccatggttcacgggcagtgatccaagcatcacaagctgtttcaaaagcactatttgacggattgtctgcaaggactattactgcattgtagagagcgtcatttttttctttcaaacttttgtaggtaggcactactactgcatctacatattgtgttactacaggattaagtactgcgtccgtattgatattgttgctattatttgcaatataggattttaagtcattcttcagtatactttccagctctgcacaagcatccatagctgctaccgtttcgttactgggaatatgattacggaaaggttgcggaatatcctgaatggcttttgccgctttttggatagcattctttatcttggtatctaatgatgaattagcaccggcgataacagtagataaagaattagcatttatattaccgtctaaagaaccgtaatatgcattccggatggaataaatgttattggtatagtcatcacgagaatgccagctgtaccaggattccacagcatataatgcttcttcagtatttccggctttatacaagttgtatgggtcaccaattttggcagtaccgacttcattggcaatttccgcgcatttatccacgatttcttccacacagctcaaggcgcttgcgtaaggagagccactatgagccttgaacagggaagcatagctttcacctcctttatagcttgaattccatgcgttgtagagattggttgcatctgtttttagaagtgctgctacatttctcatgtagttatgccagcttgatgcgttttcaggagtgtaatcaatattggcaggatctactgttgggttgtcatcatcactgctgcaagaagttgttgtgaatgctaatcccaatattagggctgcgacataaaagaattttgttttcatcatataaaaattaaataattgattatttgttatttcttaataaaccatcctatataggcaattccaatagaaaattcgttttcactgttgtatgactttgatacgccaaaaactttatttgtaccaatctggcgggttgcatagtctgcttttatcactaagtttggcaaagcgtaccaatttaatcccgctgtccacatacttacttggcaacgtttttccatcgtttgccctttttcccctttctcttgtgggttgtagtattcatagcgggcaaatggatagattaccggaatctttttattgcctccgaagaccgagcggatattaatgccggcttctgctgcataacttacggcattcttcgctaccggagccagacggctgtaaggcgatttattggataatttgacatttgcctgacttactcctaatgaatttcctaaatttccatataagatattaccgcgtgccgttacatatttattgcgatactgtgcatctgcggtgaagattcttatcggaatttttccatagtttgcataagtctgttctttatcagagttggctcctgcatctgcacaataataaaatgatgcacctacacgtaaaccgggaactcctttataatctaaacgaaatacatacgcgggagaagtgaagttgtcttcctcaaagattccctgtttgccactacctacccatgtgttacgatcgaatccattagggttcaggcctgctaccaccatagcttggtaatcgaagcttgcatacccttttccgaaagaaccaaagatttccagaccattttcatgccaggtagaaggcaaaaggcttgtttcaccttccgggcgtgaagttccgaagaaattgatcggttcatggtgtgcgttagtcaatcctaccggaacaataatatgtccggcacgtacattgagggagcggtgaattaaacgtgtgatgtgaaattgttcgatagctacttcacctcctttttcaacttctgtttcgtattcaccgttttcggtgttttctaattcgaaagctgtacctgttccaccagattcgaactcaatctctgcaccgagtatccatttggaattgaacttataatcaaaagctaaaacgaaacggggaattgaaatggtattcctgtttttctttggattaccatcgtttcctccatagaaacggttgatgccataatctttaaaattagcgaccatttcaccgtatcctccaaaacggaattttgtatattcttctgtagaagaagaattactacttttggaaatttcttttgtctcctgtgctggaattgtaagagaaggtaggagactaagaataacgattgctgttatttttctcatctttttaataattttatcggctgcaaagttagattaggttaaaaaatgtggcaatacctaatattaggcatagttgtttcttaaattcagtatatgtaggtaattttaatctaaagagtaaaaaaaatatagtagtagataaaataaaacagacaaaggtgtatttcagtatgataatttttactgatatacacctttgtctgttgttagtgtgtagagttgtctttattatttcatagtgtcaccgattttgtttgtaattgagcgaatcgtttcttctacaaccagtttccttgagtatatctaccatcaggaaactaccttttcagaaacgattcaactcagacaaactacatacaaacaaagctaaacttatgctaaggttatcgcttaaactgccatctttataccttcttttttactgcaatatcgtttgcattgctggcaaaggtcatatcccagcatggctcctaaaataaaatcttcttcagcagtcagttggtttaaaggacggatgatgatgtgccgcatggcttccatacattctgcctttccaaaaaacaggttgattttattggtacctacttcctgtatcatataactgatcttttgatttttcaatcggcggatggcaaattcttcgtgctctttactcattgtgtaaagtaccatgttgcgtacgcctttcttaaactcataaatatgattaagaaaaattcggatttcgccggggatgattctttcagttgccatgatgcaaagtattctttttatgttaaggtaaaattagctaatttcttgtttcacttgttcggcccatgcgctgatacgttcgtctgttttgctatcttcgttgacttcgtcaagtggaagacctacaaacttaccgtctacgacggcaatggaagaatcgaaggtatagcctgcagtatctgttgctccacagaatttgcagtgggtatctttcagatcttcataaagaatacctattgcgtcacagaatgtgtcgctatacgagtcagagtcgccgcaaccgaacagggctacagatttgtgggataaatcacacttctttaaaacttttactccatcgtaccagtcatcttgaagttcgcctgctccccatgtggaagagccgagcaccaatacatcatattcattgactaatgcctctgttagcttggatacatcaaatacatctgccgatggtacatctaatttctctgcaattcgacgggcaaggtcttctgttgttcctgttgtggaaccataaaatacaccaattttattcatctttgattcgtttttaaatgtaacgctgcaaagatagagggtcttaaagaaataggaaatccccatttataatggaagatttgtctccttctcattataaatggggatatatggaataaaaaatggtcgatctttttaatggtggaacaagcggatgcctgtaaatgccattgccatattgtatttgtcgcaagttccaatcacatgatcgtcacgtactgatccgcccggttgtgcaatatagctgacgccactcttgtgtgcgcgttctatattatctccgaatgggaagaatgcatctgatcctaaagctacgcctgtcatcgtatccaaccatgcccgtttttcttcgcgtgtcagtatttcaggcttttcagtgaagaactgttgccagataccgtctgccagtacgtcgtcataatcttccgaaatgtaaacgtcaatcgtattgtcacggtctgcacgacggattttttcaatccatggcaagttcatcactttcgggtgttggcgtaaataccagatatctgctttatttcctgccaggcgcgtacagtgaatacgtgactgttggcctgcgccaataccgattgcctgtccgtctttggcataacatacagaattggattgtgtatattttaaagtgattaaggcaatgattaagtcgcgttttgcatcagccgggatttccttgttctgcgtaggcatctctttcaaaagactttcatcgatcttcaattcgtttcttccttgttcgaaagttactccgaatacatctttatgttcgataggagccgggcggtatgcaggatctatctttattacattataggttccttttcttttattctttagaatctccagtgcttcgggagtatagtcaggagcaatgacgccgtcggatacttcacggttgatgatgcgtgctgtttcttcgtcacaagtgtcggacaatgcgataaagtctccgtaagacgacatacggtctgctccacgtgcacgggcgtatgctgtagccaatggagatagtttcatgtcatcgacaaaataaatcttcttcagcgtgtcgctcatttctaccgcaacagcagcacctgcagggctgacatgtttaaaagaagcggcagccggcagtccggtagcttctttcagttctttcactagttgccaactgttgaatgcatccaatagattgatataaccgggacgtccattcaatacttcgatggggagttcgccttcttttatgaagatacgggcaggcttttgattagggttgcagccgtatttcagctcgagttcgtttgccattttattaattacaaattacgagttactaattacaaattgatagcgacaaaattactaaaaaaagactagcttgcctaaagttacgctacaaaatagtagcatataattagtatttggctatttccggcgaattaaaatacctataaatgatgattgtatttcagcaaaatattccgttcctttgcagtctctaatataaataggtatgatggataatttacaaaaatataagccaactgataagatgattgatctcatcagcgataattattctttgttgcaagtgatgagtcgttttgggctttcgttggggttcggtgacaagacagtcaaggaggtgtgtgaactgaatggagtagactgccggacctttctgattgtagtcaactttatggctgaaggcttttcccggctcgatggagataaagatgatatttccatacctgcattgattgattatctgcggcaggcacatatttattttctggatttttctcttcccgctattcgtcgtaaattgatcgaggcaatcgactgttcgcaagacgatgttgcttttctcatccttaagtttttcgatgaatatacacgagaggtgcgtaagcacatggattatgaagagaaaaccgtatttaagtatgtcgattcattgattaaaggagttgctcccaaaaactatcagatcagtacattttccaagcatcacgatcaggtaggggagaaattgacagaactgaaaaatatcattattaaatattgccctgccaaaacaaatgaaaatcttttgaacgcggctcttttcgacatatatgcttgcgaagccggactggaatctcattgcaaggttgaggactatatttttgttcctgctattctgaatttggaaaggaggattagggaaaatgaaaaataacgaagtagttcgaatagctattgcagagacctctgtaattattcgtggtgggttgactgctgcattgaagcgtctttctaacgtaaaagtacaaccaatagaattactgtctgttgaagctttgcacgattgcgtccgaacgcaatgtcccgagatgttgattgtcaatcctacttttggtgattactttgatgtagctaagtttcgagaagaaatatccggtaaaagaatacgtttaatagcgttggttacttcttttgtagatgcttcattattgggtaagtatgacgagtctatttcgatattcgatgatttggaaactctttctaagaaaattgcaggtttattgaatgtggtttccgaagaagaagagatggataatcaggatacgcttagccagcgggaaaaggaaatcgtcatctgtgtggtgaagggaatgacaaataaggaaatagcggaaaagctttttttgtcgattcatacagtgattacacaccgaagaaatattagcaaaaaattgcaaatacatagtgctgccggtttgactatctatgctattgtaaataagctggttgcattgagcgatgtgaaagatttatagcctgcggaagtgttataaaatataaaaccgtttgcgtacacgaaaaatattcgtacctttgcaaagcagttgagaaattgctgttagtttataaggtaaaagaaaatattaaataaggtattagattagacagtttaaggtattaaaagttttttagtttagttcaataggataagtttttagtagaaggtaaaaggataacaataggtaagacgtttttaggtaaaaagaagattagttttcaggaaatttgaggtactatggaaaagcctttaggcttttctgatgcagtggcgagtggttctataaaaagaattagctcgttttttatttatatgggatttaagtctgtggattggattaaggtaataaaaaacaaaatcccgacgaaatcgcttcggcgggactctatttcattttttacttaaatgtggctacgtaataaaattatgactaattaattcaattctgatactgcaaagataatgcgtttcagaatgtgtcacaatcacctttatgaggtatattctgtagctattctcactatttatggttagtagcaggtgttttctctacttttttccactctttagtctcgaaatcgtatgtttttatgattcttgcagggcatccggcacatattgaatagggtgggacggaatgactgactacacttccggcggccactacgcaatgtttccctaaagttactcccggtagaatgaccgaattggcacctacccatacatcatcttcgataacaacaggcagtgtgctgacaccttgttcgtcaatcatcttttctgcatcctgataattatggttgagtcctgtgaccgttacattctgtgccaggttgacatgattgccaatattaatcggacctatgattgtgtttctcaatccgatgcgtgtataatctccgattgtcaagtcgccaactgcattattcagacaggagaagtcttcgacaacagaatatttacccaaagagaatcggttgaaaggagggaggtctttgcgtacactccgatagatgacagaaccctttccgcgtttcaggtatatgaaatcgaagagccgtatccaccaattagggcgagttttaacggggtgcatgataaaacgatgtacagcctgttttaagccggggttttctttaattcgctgtttaagtgttttcttctccatattgaatgttttttcttctttttgtcctctaccagataatcaggaattgccaggctataagtgattaatagaccgaaaagtgcaatccaccatccgaatgataaggtccaattatatacggtaatcaacgaagtccaaatacttacgaagatacataatttaagtggagaaggcgttaattgttgtacgatccggttgcagaaactccagtttccttcaaatatggaagggagtaagtaggaagttgttttccggatacgtttacggtaaggacaggcgggtgcggactggcaataaacaatcacatccggcaagtagtcaatgtatatattctgtcggaataattttcgttcgatattagtcttagaacttttcatgttcttttgcagccattttaggtcgattgccatattagttcccaataaattggatgacagtccgaattgtgtattgccggctctacagaggctgttttttatttcctcacgtatagcccggaagcgattacggatgcctttgcggttttctactatcgtatgtagttggatggcttgtacaccggcatcataggcattatatatcttattcaggaattgcggagataaagcgcatgctgtattggacaggaagagaaccagatcatatcgttcctgatctaaactgttgattgcctgatatagatcgctgtatgtgataaactcgtactcttcttctttatacacatccggaagaatacttccctccggaacgagaatggcacaaccatattccttttgagccttcgggtaggtgatatgtttgaaatgtgaggctatggccatcacaaagaggtataggagcaaaagccctgtacagaagaataccagatcatctattatgtagatataagagtctatcatctggaaggagattatacgttctctttttgaatgaatgcagtaactgttttcagaataatctttatatccaaccagaaagagaatgtctttgcataggtgatatccaattgcttgcgttcttcagcagaaagtttaccggcttcgcctcttttctctacctgccataaaccggtcaatccggccggacccatgaaacggtcgatgtgttcatcgcttgtcagcaactcggcttcatagagtgggagagggcggttgcctactattgacatatccccttttaaaatattaataagctggggtaactcgtcaatactatatttacgtataatacgtccaatcttagttattcgagggtcattttccagcttaacgaaagcattgcttttttccttggacttcttgtttatgtagtcttcttcggagattacgaaatcgtcagatatcaagaggatttcttcttcatcgatttcttcattcacttccgcttccggttcttctccccaaatatcctcatcttcctgctgatattggttaagggcattgaaatcctttaaatgcttgtctgcatcagtatacatcgaacggaatttaagaaagtcgaatatctgataattacttcctacgcgcttggatttgtagataataggacccttactttctatccggatagctagtgcagtaaatattaagagaggagaaagacataatatcgccattcctgaaaagaaaatatcaaaggttcttttccataaaggcaggcggaaagcatttatattttgtgctttaagttgaagtgcctttattttctgatcttttcttcgtttaaggaaagttgataaatcttttaaagcctcctggcttgtttcatattttatcgtattgttgataccggctttaaggtattcggatgcttcttccttagataaggagtcgataacgagtaccatataaagccccggatactttttacgcatgtattggatatctgcaatatctttggatatgttcacttgttcgaaaaatagagctgcgtcatatttttcgcgtattttctccaatactttgacagctttgctacaattgggtgcagcatagaataccccaatacttagtcgggagagtagttctattgttttgctatctctgcctatataaacaaaatattgcatgtgtagaagacccggtattagtcaataatctttttgattcggattttgagttccaaagggttgaatggtttcaggatatagtcttctgctccttcttccaatagtctgattctttccgttgtactttcctcactggataacataacgataggaattgacttgaataattcattgttcttcatgtatcttaagaattcatcccccatcatgagaggcatacgaatgtctgaaataatgaggtcaggtacattgccttcattaagccattctattgctttgatgggatcttccaaataggtaaaatcatactcttttcctagatacacaccggccacttttccgattgtcgatttatcgtcgactagtaatatttttttcttcatacgaatagacctttctatcgcttgctttgttatttgatttatagattaagattgttgtcacataatatttgtgatacactgcaaatatagatattattttagaataatccccaatcaggagagtaaaattcgtgatatatcttttttttctattaattgcaacttacagcatcttaatgaaaaaacacggattccataaaaactggaatccgtgttaaagattaattgttaggcttatttatatactcttgatgaatcaaaagttttccaccattcttcattcttagtaccgccactggtcacccaactttcgaataacgagtaagctgatttgatattcacatattccaaaggccatttgaagtctgtcggaaccatgattccccatgccaggttatctttgctgatgtaatatctcttgcgggaagtagaactatcgtcgttgttgcctccgaacaagtcggtatttgccaacttagttggttgataaccgacaatatgaatctccttacgctggtttctgtttccttctacgaaaatgaaaacattcagtttattgatattaagctcatccacagagataggattgctgaactttatagtgaaactgatatttttaggactcgtattggcagagtgacctgcaatcgtattgatctgttcgtaacggtctcttcccaatgctttgtgagcatcgtcaaataatggaataaccgcatagtcctgtccgttctcaatcagattactattcacattgaaacctttaaaaagagagttgtcactgaattccaccggctgcgtaatggcactggcaggaacaccgtccagcatgatagcagctccaatactcttggtagctccggcagccgataaatcaagacttaacgtgaactcttctgccttattgctcttattgatggagatctttctttccttgataatcagaacaaggtcgttcatatcgtaatccccatataaaggccattggtcttcaaacagataagcataattgcgattatcatccatgatgatcgggaacttaggatcttcaggatctcctccttcatttccaccatttttaattcctgtacaaacatcgatgatgactttagagtctcccattttggtgaagtatgggccattcagtacatggaagttttcccaccattggttcttttcaacgtggctatcacattcaataaccaaatttccatcatatgtgaaaccttgtccggtgataaccggtgattttatcatagaagtattttcgccttttccataaaacttggcataaccgggaggtatgctgatacttgtcgtagcatccagcatagaaccatcacttaaatttactgttccattaacaaactccattttaggagctttcaaatatccttgagtaaagttaaacgtcgctccgttggcatagaaagaagtcgttgcttccatgctacaagcgttgttgacagtcgtattggtgagactgatggttgtaaacttcatgatgttgttgttggtagcaacagcgtcggaatttgcaattaatttctctccataaatctctccgttattttccaaagagaaattagacggcagatttaattctccttccaaactgattttattgtcatttacaattttcgtattggaattgattgagatattcttgctggttatggttcctttgttgtagagtgttgcaccggaatgtagtgtcattgtgttcgctacagtcagtgcaccccagtttcttaatgcagcaggcgctccattggtgaatgatatatcctctgcattcacttctcccttttccataatggtcaacatggagtttctaatgaacgtcatggttcctgatgcttcaattttagcattattcatcacaatgatttcaataccgttttggaattggaatgttgcgggaatcgtccatttagcatctacataaactttggttgcaatttcaccgtcataaccgtcaaacttgaatgtgccggcatagtcagaggtgattttgtaagaagcatcacgcagcaaagtggttcctgacatttcagtcacttcttttgcattagcaggtatggaatagtaatccggcttttcaaatgaaaggcctcttgtagcagcggcacgactcatcaacgctctattttgtgcagtagatcctgcataatagagtttacaggtaatattatcactgttttccggcacatcgaactgatatacctgttcacgtcctctagggtcggtttgcttcacataaatacccttttgagttggcagcagactgacagcggttgtaaatttaaagttgttttctttattagctgtccttgcagcgagcacggaagcgctttcattagtcaaaggatcttctgcatatatttcaactaaataagcaaatagtcctccttcttcatctttcacttcgaccgagacatttttagtggttatcatgttccaatcgatatcatcgggagcagcaaagccatctcccatcgggttaggtgtttcgtaagacggatcatagagatcctttccagagtcaacacaactagacatagtacctgccatcgctattgcaatgatgggtacaaattgaattgttttcttcatcataatgtattattgcttgattgtttgtaaccaaatccatcacaaaaataactgcatatcttttattggaaatgttttttctgttattttatggagtgaaaacaactatacttccgttttggttcttctttggctcttttaggtttgattcggtcttgatgatgatgaagagaaatcccctgattttcacttttatacaactgtttaaaatgaaaatcagggggttacaatagatggatttaacttaagacttggtgatttctcctattaagcaggagttcattttatatcggatatccttgttgggtaatccatgtcccaataaaaacatgagctttgttatggcacattcgggggtactgtcatatccactgattacacctgcttccagaagatgcattcctgtttcgtaacgtcccatttctactgctccggaggcacattgtgtaatgttgacaatgataattccacgatcggtagcttcctttagttggcggatgaaccattctttttgcggagcatttcccgaaccgaaggttttcatgacaaccgctttcaatcccggaacatgaagcagagaagtcacgatactctcttgaatgcccggaaaaagcgttagaataactacattggtgtcaaacaggtaatgcggctttaacggttttgtcgggtctggttttcgaatgagattaggctcatatttaatgtggatacctacccgtgccaatggcggataattgaaagagcggaaagcattgaaattctccgcattgattttggtggtacggttgccacgcatcaaatgattctcaaagaaaatacaaacctccggaacaatggctgtaccatccggatttttagctgctgcaatttcgatggctgtgatgaggttttcctttccgtctgtgcgcaaagtcccgatcgggagctgggaacctgtgaggatgacaggtttgcttagattttcgagcatgaaacttagtgcagaggcagtgtaagccattgtgtctgttccgtgaaggatgacgaaaccatcgaaataatcataattgtaattgatgatctttaccagttttgcccagtaagcaggttccatgtccgaagagtcgagagggggatcgaattggtaggaggaaatgcggtagttgaatcttttcagttcggggacgtgcttaagcaaatgatcgaagttgaaattttctaaggcacctgtttccggattctctatcattccgatagtcccacccgtgtaaattaacaaaacggaaggagtttctgctctcataattgttgaattactgttaaaacattggcaaagatacggattaaatgcgaataatgagtgctaaacgacgaattatataaagttggaaggacaagactataaaaaatatctatgttgcatttttgcgatatgtagtatgaaaaaatgtccccatctttggggcaggttggacgaagtgtccggctttaaataaaaaacgaaagagaaaatgaaaaatgaccggtattttccgttagaaatctgtttttgggcaggcgacaatttgagcgtcatgatatatcagatagggggagtgcaacttgtagggatttatgtgttgttgctgtatctgtgtgcaaagaatgactacagcaaatcagtggttaatagtatgcaaaaaccagtggaaaaaagtgcagtggaaaaaaactctgaaacgccgatggataaagggcaaaaaccgaatgaaactcaagagagtagagtagaagagaaatattactactgttgtaaacaacagcagcaatattggcgaggaaaggaagactgctgctgttgttgttcggacttcggattcggtgaatgacaggggcaacgagattgtcagcccacgcctcgatcctgttcagtccacgtcttgtttttgttcagctcacggcttgtctctgctcgtcccacgggtgaagtacggcctccccacggcttgcagaaatagccccacggtttgcggaaatagccctgcggcctgcggaaattttcatccgaggctcttacttcagggcttctttcagtctggtaatcgccttttccgggtctttttcttcttcgagcagagtgacgaacttactgccgatgatagctccggaagcgtgttcgcaagctgcttggaatgttgctttattggagataccaaatcccaccatcaacggattgttcagatgcataccttcaatctttttgaagtaagcccgtttttgttcgttgaaatcttgttgcgctccggtggttgctgctgatgaaaccatataaataaatccgtcggtatgtgtatctatctcgcgtacccgttcttcgctggtttccggtgtgatgagcataatcactctgatgttatagcgttcggcaatgatacgataatgttcttggtaatcacggaaagggagatcagggataatgacgccgtcgataccacattccacacatttacggcagaaattctcaaatccgaattgcatgattgggtttaaatatcccataagcacaagtgggatttttacgtccttgcgaatatcccgtaattgttcaaaaagaagttttagagacataccattgcgcaatgcctgcgtagcggcattctgaataacaatgccatctgccatcggatcactgaaaggaatgccgacttcaatcatactcactccgtgcttttcgagcgtgcggattacatcagcggtaccatccaaagtaggagtaccggcacaaaaataaatagagagtatgtctttcttgttgctattgaaaagttgattaattctattcatgacgttggaatttttagattatgattttaattcgtttaaaaatgtccggatacgctccggatccttttctcccggtttcaattcaaaacggctgttgagatcgtatccggcaagccggggatgtttaaactctttcagggcattggcactgtatgagttaatgcctccgctcaataggaagggtacatgtccattgtacatatccaggatactccagtcgaattgatttcccgaaccaccatattgttcgcatttggtatcgaacagaaaaagatcacagactttttcgtagtcatatacctttctcaaatctttgggacggtctactgaaaaagccttgatgattttcaatccagtggaatgtaaggaccggcagtattcgggcgattcatttccgtggagctgtacataattcagtccgaaacgatcagcatacatgctgattatctgcttgtcttcgttgacgaaaactccgacacgtcgggcatgaatgggcaagtaagccggaagctcgtagacatatcggggagatttaggatagaagatgaatcccagcatatctatgccttcgatagactctacgtcctgtatgttttcagcttcacgcataccgcatactttgataatttttccgttaatcatagggctgtccgttttgaataattagtttattggattgcttgcaggaaattctgtaaagtttctcccggttgctgtgttttcataaatgtttcaccgatcaggaatccacggaatccggctgcccgaagtcggtttactatttccggatcggagatgccgctttcggataccaatacagcatcttggggaagctgtccggccaagcggaaagagttttctacatcagtgaagaaagtacccagattacgattgttgattcctaccatatctattttcttgtcgatgtatattaattcctcggagctatgaatctccagaagaacttccagacctagttcatgagctttttctgcaagttcattacatttctccggttctaatgcggctgcgataagaagtacggcatcggcaccgacaattttggcttgataaagctggtattcgtcaatgatgaagtccttcctaagaatggggatctctaccaaagggcgtgcagtgcggatgtccttcaggcttcctccgaaaaatttctcgtcggtgaggatggaaagggcagaagctcctgctgctgcataggagggaacaatttcttccgggcatgcttcttcctttatccatcctttggatggagaccgacgcttgaattcagcgataatacccgatgcagatgaggctaatgcctgcttcatagaacgagaggtcggaacttcgctgataccttcctgtaattgctcgatggagatagcctgcttttgcaggtcaacttcaaatcgtttgtttgctataatctctgataatatatctttcattgatgtgggattattaattgtaaatgatggatttgcaaaaataaaacattaactgttcaattcaatgaatttttttagggtagctaatgcgcgtccactttccaatgactctttggagagagcaatacattcttcaatagtcttctccggacaaatcacatggatggcgaaagctgaattgactaccactacatttttttgagcttctgtagccgtgttattcatgatctggtcgaaaatcttagctgcatcttccggtgtttgtccaccatctaggtcagtttccttatagcgggagaatccgagactctcgggagcgtaaatcttttcatgatcgctggtcgccactttaaactcatttgtcagagagatttcgtcatatccgtcgagactatgaacaacggcaaatttcgtcttgctttcctgataagtataggtatagaggcgaagtaacgggaggttgtaaactcctaaaagctgataggccggtaataccggattaaccaacggaccgagcatattaaagaaagtgcgcactgccaatcctttacgaaccggagcaactgcctttaatgccggattgaataaaggagcatgcagataggcaagattacatttctccatgctacggcgcagttgatcgacgttactggtgaactttacaccgtgttgctccattacattactggcaccgctgactgatgttgctccgtaattaccatgtttcacaaccgggaaaccggctccggcaacagtaaaacaggaagctgtagaaatattaaatgtattttttccatcacctccggttcctacgatatctatcggagcaaattcacttaaatcaaccggaatacgcatttcaagcaatgcatcgcggaaaccgcataattcttccacagagatattacgcatcagaaagacggtaattaaagaggctacctgtacatcattatattttccttgtgcgatgttctgtaaaatggtgcgagcctcatcgcgtcccaaatattgatgttcgaaaagtttgtatagaatctgtttcataagtttaatcgtttaagaagtttttaataatttcttttccttgcggagttaatactgattcgggatggaactgaataccatgtacattgtaggtcttatggcggattgccatgatttgtccttcctgactttctgccgttatttccaggcaatcgggaaaaccttcccggctgactacccaggaatggtatcttccaacagggatttcttttcccaacccttcaaaaagcaaatcctggtgaaggatggtaatcggagtctgtaccccatgatatacttctttgagattttccagacgtgctccgaaagcttcgccgatggcttgatgaccgaggcagacacccagaatgcttttggtcggagcatatcttttaataataggtaatagcagtccggcctcttcgggtatgcccggtccgggagacaggatgattttatcaaatcggtctacttcatcaagctctatctggtcgttgcgaactacttctacatctgtagcccctaattctttcactgcgtgcagtaggttataagtgaaagagtcgtagttatctaaaagtaatattttcatttttattgtcattgtaaaatggttgttcaaatactatctctgctttcaattttttaatttgacagctaaatcaatcgcctttttcagtgctcccagtttgttgttcacctcttgcagttcatattcatcctgactgcgtgctacaatacctcctccggcttggaaccagagttcattgttgcggcttacaaaagtacggatagtgatagcctgatttaattcgccgttcaatccgataaaaccgatacagccaccataggctccacgattatgtggttcgatttcgctgattaactgcatagcgcgtactttgggagcaccgcttaatgtgccggcaggaaacgtatcaataaacgtttttattttatctgcgccctcattcaacataccgctgacacggcttaccaggtgaatgacatgactataatattgtggttccttatagaatagtacgcgtacatcatgacaattacgggaaaggtcgtttctggcaagatcaaccagcatgacatgctctgcattttctttagggtcagccaataaagcttctgtcagttcccggtcttttactacatctccggtacggcgggtagttccggcaatcggatcgatgtaagcacgaccatcttcgattttgcaatgtgtttccggtgaagaaccgaagatgcggtatcctccgaaatcgaagtagaaaagataaggagaaggattgatgctgcggagtgcgcggtacactttgaaatcatctccggcataaggttggataaatcttctggaaagtacgatttggaaaacatctccacgcatacagtgcgcgattcctttgcggacattggctttatgctcctcgtcggtgatagggctagtaacgggacctgttacagagaagttgtaagaagcataattccggttttcgatggctgcttccagttccggtaagccgctttcttctccttcggacaacatttcaacgagtgtcaattcatttttgaaatgattgaaaacaatgacatacttatataatatgtatagcaaatccggagcgtcattttgctcatcgtgactttctttcaccgggatgtgctcgaagtatttcacagcgttgaacgtcgtgtatccgtaaagtccacatacattcttattatccccggtcacctggaattgattgataaaccggttcatggccttttctacatggaaggtttttgtcaggggttcttccgtgcggctgttatcgggatagttggaagtgacaatgccgccatttataccgatacttgccaggggacagagggctataaatgacaaggaattttctccggcatgatagtcggaactttccattaatgcagattgcggatacatgtcgcgcactttcaggtaaatgctgacaggagtatgcatatctccgagcacttgtttgctatgagttgtataattaaatgttttcatttctataattgcttgattattgattacgaatgatggtttactaattacttattgctgttcattaaacgataaataggtttcaatatctttgtctcctcgtcctgaaacagtcaatacaacgatatcttccggtttgaacttcaattttctcaaagctcctaatgcatgggcggattccagtgcagggataataccttcgagtttagtcagttcgtaagcggcttctattgcttcgtcgtcattgattgccaaaacgttggcacgtctttgtgcggcaagattggcgtgtatcggaccaatgcccggataatccagtccggcggaaatcgagtaaggctcttcaatctgtccgtcttcgttttggatgacgtaagtacgcgctccgtggataattcccattttaccgagttggatggtggcggcggtcattccggtttctattcctttacctccggcttccgccagaatgatgcctacccgttcatcattgatataatgataaatcgttccggcagcattacttcctcctccaacgcaggctatcagataatccggatagtcacgtccttctttttcttgcagttgtttttttatttcttcgctgataacagattgcaggcgtgccaccatatcaggataaggatgagggcctacggtagagccgataatataataagtgtcggcaggatggcaacaccagtcgcggatcgcttcgttggttgcgtctttcaaggtcatgtttccggaagtaacgggaataacggtagctcccagcattttcattttctccacattgatatgttggcgttctacatccgtctttcccatataaacgatacattccatatccatcaacgcacatacggtagctgttgctactccatgttgtccggctccggtttcggcgatgatgcgtttctttcccatgcggcgtgccagcaagatttgtccgatggtgttgttgattttgtgtgcaccggtatgattcaggtcttcccgtttcagatacaacttgcaaccatacttttcggaaaggcgttttgccagatagagtggggaaggacgtcctacgtagtcgcgtaataactgctcaaattcctttttaaattcttcgctttcaatcacttcgaggtacttgttcgtcagttcctcaacacatttgtggaggatttccggtacataagcaccaccgaattctccgtaatagccatcctggtcaactaaaaaacttttcataatcctatctattttttatgttattatctaaatctgttcgaaaatgggcaaataaaaagagccctgtcgcaagttgcgacagggctctttcaaatctgttatatctttaatgaggtatatacatacgagcactgctcccttacgactgtcggagttgtaacgggtgccaccaccaatatgtatttactaacattgttctcattgtcttttgtaattttatgagggcaaatatagacactttgtttgaaacagcaaacaaaaaatgactttttttctcttttgccttcatttttctgatatagaacaattttcaacctgaactgttcttataaatattgaatatttaaacaaaaacaattatgaaacagagaaaagttttagtaggtatcgctattgccattttcattatattattattgtattggttattggtagcagaggatatgaaaccctggttgtcggctatggttccttccgtggcacaacaattcttcgcttgattctgacagggttcggataaatcatatatctttgcaaggatagtgactaataaccaaaataataacaatagactaagatatggaaaattttatttttcaaaatcccgtgaaactgataatgggaaaagggatgattgctcggttggctaaagaaataccgtccgacaagcgtattatgattacttttggcggtggaagcgtgaagaaaaacggagtgtacgatcaggtaaaggaagcattgaagaatcattttacagtagaattctggggaatcgaacccaatcctgccattgaaactctccgtaaagctattgctttgggaaaagaagagaaagtagattatctgctggctgttggtggtggttccgttattgacggtacgaaattgatttccgcaggaatcctgtatgatggtgatgcctgggatttagtacttgccggacgtccagtcactcatactgtacctcttgccactgtattgactttgcccgctaccggttcggagatgaataacggggcagttatttcccgtcgtgaaacaaaagagaaatatcctttttatgctaactatccaatcttctctattcttgacccggaagtaacttttaccttgcctcctcatcaggtggcctgtggtttggctgatacctttgttcatgtgatggagcaatatatgactactcccgggcagagccgcattatggatcgttgggcggaaggcattttacaaactttggtagaaatagctccgaaaatccgtgaaaaccagcatgattatcaactgatggctgattttatgctttcggctacaatggcattgaatggatttattgctatgggagtgtcgcaagactgggcaactcacatgattggtcatgaaattactgctttgcacggattgacacatggtcatacgttagccattgttcttcctgccactttacaggtgcttcatgaagaaaaaggagataaacttttgcagtatggtgaaagagtctggggaattacttccggtacgcgagaagaacggattgatgaagcgatttgtcataccgaagagttctttcgttcgcttgggctgactacacgtttgcatgaagagaacatcggacaggatactattctggaaatcgaacaccgattcaatgaacgtggtgctaaatatggagagaatggaaatgtaacgggtgctgttgcccgcaggatattagagactgcactttaagcatactcttacattaaaaatataggataaagaggatattggaacatacttttcacaatatcctcttttctttttattatttctcaattttctctgaccttggaattctgaaccagaagcgagagccttctccttctttagattccactccgataaccccgcccagtctttctactatgacacggcagatggctagtccgagtcctgtccctttaataaaggagttcagtttgacgaagcgctcaaacactttatctatcttgtcagcaggaattccgatacctgtatcttttacataaaagtatatttcatctttggcttcttcaatccggtatcccatttcgatagaacctttaggggtgaatttcaaagcattatttgtaaagttgatgataacctgtgatagacgtatgcggtcggtatacatcatgcattgatctgctttctctgtgaataagatttgaatgtctggggaagaattcttttcttgcatttgtctgcaaataccttccatcaattcgttgatatcagtctgtgcaaatgtgaattccatagtaccggcttcaattttagaaagatcgaggatgtcgtctattagttgcaataataagatattgttgctggagatgatttttacaaattcttttctctcttcctcttcctccgtttggcaaaccatttcggagaatcctacaatcgcatttagcggggttcgtatttcatggctcatattagcgagaaaggcagatttgagccgattggattcttcggctttttcctttgcttcctgcagcattttgtccatctttaatttttcagtgatgttttcaaaacgaagtaatcctccaataatttcagtttccttttcatcgccgaatacaggtgttgcggtcacttcaaaatctacatcgtctactctgatggtatgccggataattttgccctgttcgatagctttcttgaaagcacattgtccacacggttcattacgaagtgcactggtctgatagcaaatttttcccggtatgtatcgtctgccttttaccaggctggctatttgtcttgtttcctcccattgtacccggtaatttttatcaatatagataaggccgaagtcgatactttttagagctagtttttgcttcttcaatgctttttccagttcttccttggcggcaactaattctctttcataattcttgagttgtgtgatatcccaccgggttgccaacagccatttcttttctccttcccatgaaataatagatttaacggcaatagtatcatgggtgattccatcgggagtggtgtatttctcttctttgcgatatactttgcctgcttgtatgagttctttgtcgatatgccggtatttttcacctctttcttctccgtaaatttcataatcagtatgtccgatggcctcttcactgctaatgccggattgagcggctgattctttattccagtaatagtatcggaaatcgtttgtaatatcttttacaaagatggggaaaggaaggttatcgagaatatcaaaggagaaacggtaggaatgattggtctttttaatcgttttttgcaattttcggattctatatagtaagatgctgatgacaaggagcaaaataactactagtaaataattataaccccaatgaacttcgttaatccaataatttaacaaataattgtttgccataaaatgtttgatataaatgaggtgtaaagatatgaattgttctttaactttcaaaaaataatacataaatatattgtctttcaacattatattgtgagactgtaattatatgcgatgaagaaatagtggaggtatggtgtcttgtagttcttgtatagtatcatattttgcttgatttcgagtcttttttcagaaagaaaatgtattaaaatattaaatgatgtctcatgaactaaaatcatttctagtttgttttaataacgctggagtattttctatttttgttcacctaaataagttttgatagagtcaaaataaaacaatcatttaattacgtatgctaataaccattattattctcgttctttcggctgtctttttcgtgaacggcaaggttcgttcggatattgtggcactgtgtgcactgatagccttacttatttttcagatattaactcctgatgaagcactttccggtttttctaattcggtagtcattatgatgatcggattgtttgtagtgggaggggctatctttcaaacgggattggcaaagatgattagttcccgtattcttaaacttgcgggaaccagtgagatccggttatttctgttggtgatgttggtgacttcggccattggtgcgtttgtcagtaacacaggaacggtggcactgatgcttcctattgttgtcagtctggcaatgagtgccggtatgaatccgagcaggctgttgatgccgttggcttttgcaagtagtatgggaggtatgatgactttaatcggtactccgccgaaccttgtgatacaaaatacgttgacttctgccggacttgaaccgctttccttcttctctttcctgcctgtcggcattgtctgtgtgattgtcggtacgctggtattgatgccacttagcaaatggtttctttctaaaaaaggccagaaagatgataataaacgttcgggtaagtcactgaaacagttggtaaatgaatatgggctttctagcaatctgtttcgtttgcaggtaataaaagattcccggcttttgggcaagacgattattgacttggatattcgtcgcaaatatggtttgaatatcatggaagtgcgtcgtggtgatgcatcgcaacatcgttttctgaaaacgattacccagaagtttgctgcaccggacacgatgttgcaagccgaggatattttgtatgtgacaggagaatttgataaggtacagctttttgcagaagatttcctgctagagattttaggtgaccatgcaacggaagaaactcaaagcgcaactaactctctggatttttatgacatcggtattgctgaaatagtgttgatgccagcttctaatttgataaaccaaacaattaaggaagccggttttcgtgataagtttaatgtgaacgtattaggaatccgtcgtaaaaaggaatacttgttgcaggatttgggaaatgagcggattcatagtggtgatgtgcttctggttcagggaacgtggaataatatagctcgtcttagcaaggaagattctgattgggttgttttgggacaacctttggcggaagcggctaaagttacattagattataaagctccggtagcggctgctattatggtattaatggtagtaatgatggtattcgattttattccggttgctccggttacagccgttatgatagcgggtatattgatggtattaaccggatgtttccgtaatgtagaagcagcttataaaacgatcaactgggagagtattgtattgattgcagctatgcttcctatgtctctggcattggagaaaacgggagcttcggaatacatttccaatacgctggttaacggcttgggatcatacggacctgttgcgttgatggcaggtatttactttacgacttcgttgatgacgatgtttatcagcaatacagctacggctgtcttactcgcaccgattgctctgcaaagtgccatacagatcggagtaagtccggttcccttcttgtttgctgtgacggtaggtgcaagtatgtgtttcgcttctccattctctacaccgcctaacgccctggtgatgcctgccggtcaatatacttttatggattatgtaaaagtaggattgccgttgcagattattatgggaatcgtgatgatttttgtattaccattgattttccccttttagtttttaatttttatccttttaataaggagatgaaagagctcggtattttgtagttgtagtgctttgtaacactggatctttgtcgtttaattgagagttgcatagaatctgcaactcttttttttgattgcatattgcatatttgtacttctaagcttttaatattcaataatgtaataggtcgttttttattgggagtaattaaagccttatcttttaaaagatgttaaccgtaggtcgaaaaatacaactttatccgtttcttatttgtaaatacaactatctttgtacattcattgctgattgttgattcgtaatgatttttattttttgtgcaaataaagcaaacttaagtatttaaagattatgaaacaaagcattgtaaaaatcttcactttttcgttgttagtatcttctatcagttttattagttgcgttgataatgagaaaaatctgtttaatgcagatcaactgaaacaaatttacgaagaaacttttcctgtaaaaaacatcgactctgatggtgattggacaatgtcacgaagtgtaacggcacatgtgtcaatcaatggggatcaaggagtagattataagatacagatatttgatgccgatccattaagcccggaaagtacagcaaaactcttagcggaaggaactgtcactcaaagtatgactttggatgtggtgatggattgcgcaacatctcttgataaagtgtttgttgcgcgtatagatgaacacaaacgttatctggtccaaccgacagcgattgaaaatggtacagtgacagcgcactttggagacaaaggtacgccaacacgttctatatcacgagctgtgacgactagtataccagtcatggaagctccttatacagccgattttattagtgctaaaaaggcaatttctactgtcattcaggctaattgggatctttctgcaaagtctggctggggtggaagttatggtcaatttcctgtttttacagaaagtgagcgttggtttaagattcaggaaggaacttttaaagctggatttagtgcaactggaaatagagatggagaaataagtgctgtgaaagtaatcgttcctcaaggaagcacatgggttatagagaatagtaatcaattttctgatattacagaaattatcgttgagaatggtggaaagatagagattgctaaaaatgggagtctgatattaacgcgggcttcttatataactgtgatgcagggaggaagtattgttggtgacagaggtattcagataacaaatagttcggctgggcgtacaaactataatgcgggtacgattgattgtgactttttgaaaattgatggaagtggaaacggagttgattttgtgaattatggaacacttaaactgaattcttataatgcttctacaaatggtacgacattgataaatcatggaaccattgaagtcgaaaatatagatggcaacaataatactaatattaaaaacggttgttatctgaaagctggaaaattacaatttggtacgcttgttatgggaaatacttccgaagctatttgcaaagaattgacgggtaatggaaatgataataatatcgtgatggaagcacaatccatgttgacttgtacgggcaaagctaatttattcagaacagttaccggtccgacacaaggaactgccttattaagaattcacgaaatagataatacttccggtctggctcaatctgcttctaaagtaagtaataatatcatttgtgaaataacagatcaaacatataaaggcgaagcacattataactggtctccttttgcatggctagtaaataagggattacagcaaggtgctacctattgtaatccgggcaaagcagaatttatacttcctgctgacggtgactgtgttaaagaagggtataactctgatgaaaaaccggatgatgtagaaattcgatatgcagtttattcttatgctttcgaagataactatccgaaagcaggagattacgatttcaatgatattgtgttgaatgtaactttgcctgcagccggtaatgatgtgaaagaactaaaatataaaattgaccttcgggcagttggtgccgtgaaacaattaggtgctggtttgagaatacgaggaatagacaaaaataatgtggaagagataagttttggtgcaggcgctgctcaacgtaccggctcattaaattctggtatatttgaaaatgcatcttatgaagccaatggcaatgaacttgtgattcctttatttggagacgcacattatgtatatggatatacaggagcacaacgccccatgttgaatactgggaatgctagcactcctcttacagatatatatactcttgaagtgaacgtcaaacttaaaaatgaaatatccgtccctagtgtgacagatggtttagacttcttcattgcttatcaggggataggtcaaaagagaacagaaatccatttgactcattttaattcggctacggcgaatggacaattggcggataatgaggtgcttgaggtaatcaaggcagttaataatacatgggctttgtgtgttcctgataaatttgcttatccaacagaaacaacagtgataacgaacgcatattctaaatttgcagattgggcacacgatcagagctcaactactgattggtataagacagttagtagtgataaagtgattcagtactaaaactattaaagagaaatattgcaaacagttttattcgaaaagaacttgtgtgcattgattatggggagattgtaggaagtaagtgctgccttaatgctccccttttttatgtaattacccattcgatgacaaagtaaatacataaagttttagaatctctgattattctgacgattgttcgtgtaatcaagggttttgctatctctcatgttctatcattcttctctattagcaggaaaatccccatgatttattgaaaaacaatgcctttattgcgtaaagcaccgcatatttacatcaaaagcgccgctatatttgtaaaaaacataaggataaagtaagtaaaagatgcggataatgtcatcaaaagctatggatgaagtaaacaaaccattgggatagtgtcgctatatcgtaaatgttgttagaatttcctactttctttccattgatttttctatttggggctttgataatggtaaaaagaaaaaagtaaaagggaactttattagtacatgtgatgcccgtttgattgtagaaatgctgtgcgcgtattaaaatgtatatatatcatgcttaattgtagaatagtgaattgaataaagccctctacagtggcagaaaaattttacttcagccaaagggaggaaagaagcgatccctgatagattaagaattacaaagtgtcagtagtatctttttgtaaattcaaatttctcatgttgaatgttttgtaactgcaaagatacgaagaatggtaactatattgaatgatagttgcttaatatcatagcaggaccgagctccagagatgtacaaatcaggcgatttaggttattcaaccttaattcgcttttttctgcatcactactatctgattaaaccgtttttgtgacggagtaccaactacaatttcttttggaggaaatcgcttgtcgaactcattagcagcagatttatcgatctgatatattttatcttctatataacggccttttgcattggctaaagcattatcatataattcacaaacatgaagagcagtagcatacatattgtcttcagtgcgaatccctaatgtttcggcaggaatgaatccttgtcggagataataatccgggtcaccacaaagtaaaatagcacgaaatcccatttcggaagctaattttttggtaagtgcaatcattcttcctccgataccttgctgttggtattcggggaggacagaaatgggccccaggctcaaaacctcatattggttaccgtcatctgccatgataaatgatttgaggcagacaacattaccgacaatcttgttattatgttctgcaacaatatcgagctccggcacaaacttaggatggttacgcataatatgaaggaggtaatgttcgtcacatcccggagaataatgattccagaatgcttcccgtgtaatgttttcggtttcatgataatccgaagattgctcaattctaagttttatatccatattgtttcaaatatatagttgcacaaatataaagaacaaaatccgaatacctaactcttttaaagatgaatctatacattatagcaagatgagacaaaaactcccgatactagtatatccagacttagtatcaggagttttttatatattcattcatcaagattgcggagaatcaggcctgttcatgttttgcgtgtacaagctatctataataccgtcggacagtccgatggtaggtacaataattccgctagcttttacatgagtagctatctcgagaaatatctctgcagcaggaacaataacatcggcccggtccggtttcaacttatattgcttaatacgttgttcggtagagagggcttttaatgtttcatatatatcttgcagtgattcgatgggtaggagagacgcttttttgtctttcttgtccgctaaacgaaataacttattaatatttcctcccgaaccgatgatgctgataggggtatattctgtggcaagccctatcaggtcagtgcgcaaagcttccttttcttcttcctttaccataccgctaagcatacgtaccgtacctatattatatgaacgggaatttttcagttcaccgttgctgatgagattaatttccgtactaccacctcctacatctacatacaagtaattttgtcctgaagcaaataactgttcgatatgattgtcgtaaacaatatgcgcctcttcctgcccgtcgatgatttctacacggatacccgtttttttgacgatctgctgaacgatatccttgccattacgtgcatcacgcatggcagaggtggcacacgcacgatagtctaccacatcatatatcttcattaattgtttgtaggctttcatcagccgaatcagtttcttctctttttctgtagagataacccccacagtaaaggcgtcttctcccaaccgtaacggaatacggatgagctgtaccttactcattaattcgggcgcattctcctcgtttacacattttatcagcagccgcaccgcattagagcctatatctattgccgcataattaactttcttcatacttatcataatgtattcttgtattcgttatataatttttcttgtgagcggaatgggacactgttctcttcccgttctttttcccggttctcgcctgtaccatccacaattcttccttttgccgtatcccggaatccgtagcagacaattcgttttaaatctgcctggatttctttatcatagaccggtgccgccacctcaatacgattatccaggttgcgaggcatccagtcggcagaaccaatgtagtatttttcttctccaccattggcgaagatgaaaatgcgcgaatgttcgagataacggtcgataataccattgatgtgtatattctcgctgatacccggaacgcctgtcactaaagaacagttaccgcgtactaccagttccacttgaacacccgctgttgaggcttcgtatagcttttcaacaagtgcacggtcagtaatatgatttactttagcaaggatataagcctcttttccctgttccttattttttatctctttgttgataagcgcaatgaatcgtttacgcatatcattgggagaaacgagcaattctttgaaatcaacaggagtataaggcttttcgataaaatcgaatacggcattgacttcccggacaatgggacggtgagcagtcataatggtatagtcagtatacatacgtgcatttccttcatggaaatttcctgtactgatgcaggcgatatctccgtgccgagtgccgatatgcagcaatttagaatgaattttcaaaccctctactccgaaaataacatgaatccccgcatcctgcattttcttgctccagttgatattagacgcttcatcaaaacgtgccaacagttcgataactactgtgactttttttccgtttttggctgcactgattaaagcctttatcactttggagtctttagccaaacgataaagcgtcatcttgatactttttacttctttactgatagcggcttctcgcaacacacggatgaaagtatcgaaactatgataaggataatgtaaggaacgatctttccgacgaatcaaagtgagcagactttccatgccattcagttcaggcttgaagataggttcccaaacaggatatttcagttcatgatgaccgcaaaccggaaatttcatcaaatccttgaaattgtgatagcgtcctccggctacacgcgtgtcattcttatccacgttcaggcggccggtcaactttttcagcaagtctttaggaatttgttcgtcatagacgaaacggatcggttcccctttcttccggcttttcacacctttggaaatcttctgaagtacccctgtccgcagatcactgtcaatttccatttcggcgtctttagtgaatttgaaagtgtacgcctcataatctgtgtacttcatgccaacaaaaatcatcggcaaacaatagcggatcacgtcatcaagaaacatgagatatgtttttccatccgaatcaggtaattgaataaaacggccgaagtctccgatcggcagttcaatcactgcatagtctttctcctttatctttcccgtttcatctttgcgcagcagacggatggcaaggtaaatatcctcatctgtctgatcgtccagcgggcgggttccattgaggaaaagcggattggtagaaccattcagtttgttgcgatagaaagaagtgacgaatgctttctgttcgtccgtcatttccgcatctttgatgacgtagatattctctttcttcaattcctccataatggaagcgaatatctcctcaaactgcttgtagtaacgattgtgcagctttcctatttgtttcagagtgcaggcggcggtttcttgttctgcttgtatgtttttatcggcatattctacgatccggttcagagtcgctacacggacacggaagaattcatccaggttatttgaatagatgccaagaaaagtgagtcgttccagcagtggcacttctggacgggcggcttctagcagaatacgttggttgaagtacatccaactgatgtcacgctctacataagggtatttcttttttatttcgctttgtttcattgtgaaaaaggaactgtttaaaatttctgcaaaaatatcaatgtgagatgtaatcgtcataacgatattattacgaacttattacaatgtttatttgttatttttatatatcagtagaaacacttatattcgcaaaagtattggaacagactcggttaaaaaatatagaatttatgaaaacaatgaattattcccttattcgcattctcttcgcacttgtgattggattggtactcgtgatttggcccaatgcggctgccagttatattgtcattacggtaggtgttgccttcttgattcccggtgttatcagcctttttggctatttcggccggaaaagaccggaaggtgaagcagctccccgttttccgatagaaggaatcggtagcttattattcggactttggctgattgtgatgcctgaattctttgcagacgtcctgatgtttttattgggatttatcctgattatgggaggagtgcaacagattgcttctttgtcgatggctcgtcggtggatgcccgttccgggagctttttatctgattccttcgctgattcttattgcgggtattatcgctttgttcaatccgacaggagcgcgtaatactgcatttataattattggtatcagcagtttggtttattctctttccgaattgataaactggttcaagtttgcccgtcgccgcccgaaggctccggttatgcatgacgatgatgatattgaagacgcaaagattatcgaataaaaaaagaagaggactgcttcacagcacccctccccgcaaacttaaaacaaccaacaaaagaaatagataatttcaataacagtgaacggctaacggtgaatattctgcaatgataatgcagtttgttcaccgtttactgtttatcgttcaccgtatttttttctatctcacaaataacagttccctgtattttggaagcgtccacatctgattgtcaacaatcagttccaacttgtcgatgtgataacggatttcttccagtgccgggacaatcgtgtcgtggtaggcaatggctttttcccgttcgctttctatcttgtttgcaaccttacgagcctcaatcattgcatctacatgctccttgatgaaagctgtacggtcggcaatctcttcaataagctccaggttcttagcagacaatttcgcagccttttctgccgggaaaagagattgcatcttatagacattattaattaagtccgtctggtattgagtggcaaccggaatgatatgattcattgccaagtcacccaatacacgtgcctcaatctgaatcttcttcgtataagtttcccatttcacctcgttacgggcttccagttctttcttggtcattacaccggtagcttcgaacatggcaattgtttccggtttcaggtaattgtcgaagataacaggaacactggtttcgcaatccagtccacgacgggcagcttctttcttccattcgtcactgtaaccgttaccgtcgaaatgaatggctttacattctttgatatatccgcggatgatttcaagaatggcggaaactttgggttcccccttttcaatcaacgcatccacgtcctttttaaacttcaccaattgatttgctacggccgagttcaatgcaatcatggcagaagcacagtttgcttcggaacctacggcacggaactcaaagcggttgcctgtgaaagcaaatggagaagtacggttacggtctgtattatcgatcagtaattcaggaatctgcggaatatccaacttcattccctgtttaccgctaaggctgattaaatcatctttcgtactgttttcgatatgatccaatacctgcgacaactgttttccaaggaaagaggagataattgcaggaggtgcctcattcgctcccagacggtgggcgttggtagcactggagatagaagctttcagtagtccgttatgatgataaactgccatcaatgtattgacaacgaatgtaacaaaacgcagattgtcttccggagtcttgcccggtcccatcaataagatacctgtatcagtgcccaaagaccagttgttgtgtttacccgaaccattgacacctttgaacggcttttcatgaagcagtacacggaaaccatgacggcggcttaccttacgcattaatgacataatcagtaagttatggtcattagcaaggttacactcttcaaagataggagccaactcgaactggttcggggcaacctcgttgtgacgagtcttaacaggaatacctaattttaacgcttcaatttcaaggtccttcatgaaagcggctacgcgggtggggatagcaccgaagtagtgatcctccaactgttggtttttggcactgtcatgtcccatcaaagtacgaccggtcattagtaagtccggacgtgcggcatacaatccttcgtctaccaggaagtattcctgttcccatcctaagtaagcaactacttttttcacttccggattaaaatactgacatacggctacggctgctttatctacagcacgcaatgccttcagtaagggagctttatagtcaagagcttcaccggtatatgcgataaatacagtcgggatgcaaagtgtatcatccacgatgaaagcaggtgacgaggggtcccatgcgctgtatccgcgagcttcgaatgtattacggataccgccattcgggaaagaagaagcatccggctcctgctgtacgagcagtttacctgtaaattcttccatcataccacctttgccgtcatgttcaacgaaggcatcgtgcttttctgccgtaccctcggtcagcggtgcaaaccagtgcgtgtaatgagtgacacccatttcgatagcccatttcttcatgccggcagctacctcgtcggcaatgctgcgatctagcggagcaccattgtcaattgcatcaatcagtgcattgtataccttactgggaaggtatttgaacatcttttccttgttgaatacatacttgccgaagtattccgaaggacgttcggcaggtgttgctacctcaacagcctttttcttgaaagctgtctctactactctgaatctaagttttgacataatacctaatttgatttgttgttaaatatgttagagcaaataattttctctgtgtggttcccgggaaggcggtcaggcccgcccgggataaatctttttaatctatatagcctaattcacttactgatgagtagacttacttttaattataagtaacttagttgtaagcagattcaccgtgttcgtaaatgtcaagaccttcttcttcgacacgtgccggaacgcgaagtccgtgaatcttatcaagcgttttgaaaatgatgaatcccatgcctgctgcccatgcacttactaccaatgctccgaatagttgtgcaccgaggaatccgaaaccgtatccatagaataaaccttcactggtagagaacaaacctgtgagaattgttcctaaaaaaccacacacaccatgtacggaagatgcacctaccggatcgtctatttttagaaacttgtcaatgaagtcaacggagaatatcattacgacaccacatatcgcacctattaaggctgctcctgcgggagatactgcgtcacatcctgctgtgatacctaccagacctgccaagataccattcagtgtcaatgacagggatggttttccatatttcatccagctcaccaacagagcaaagaaaccaccggcacaagcagccaggttcgttgtcaggaatacgtgggaaatagcgattgcgtcggcttcggttgctgctgccaattgagaaccggggttgaatccgaaccatccgaaccaaagaatgaatacccccagtgcagcaatagtcaggctatggcctgggatagcttttgatttgccgtctttaccatatttaccgatacggggaccaagaatggcagcacctaccaaagcaatccatccacctacagagtgaacgactgtagaaccggcaaagtcatggaatgtagtgccgaagtgactcatcatgaaagaaccttcttcaccgttcatcagccagcctccgccccatgtccagtgaccggatatcggataaatcagtacactgataaagatggtgtagacgatatacatggagaattttgttcgttctgccatggctcctgatacaattgtagctgctgtcgcacagaatacggtttggaatatgaggaatccttcggttggcaaaccattattaatgaaagaaaggtcgcagaagtgaggcattccgatgaatccgcctgcgccgaacatcaatccgaaaccgataaaccagtatagtaaagagccgaacatgaagtctacaaagttcttcatcagaatgttggcagtatttttcactctggtaaaacctgcttctactaatgcaaatcccggctgcatgaagaatacgagcattgctgcaagcaacatccatacagtatttaatccaagagctaattcaccaaccgtatcgggagctgctgatgcttcttcggcaggagctgcaacgacttcggtaattgtttctgtaactgctgcaactgtatcggcagcggctgcgttttgtgccgacatatcagtagtaaaacagcacaaaatgaatatagtagtggctatccacaactttacgaagctatggcttttatattttgtatccataataattatcttattttatacctattatttattagtgatgttgtaaacctctttataaacgttataatccgcaaggaaacctgggagcggcaccttgccgctgccgattaacgttcttgttctgcattgtagagggctatgtcaccacgttcggcagtgcgtatccggatagcgtcttcgataggaatgacgaaaatacgtccgtcaccgatttctccggtctgtgcagctttgatgatagcctgcactgttttctcggtatttttgtcgcgtacgacaatagagatcaaaattcgttcaatggtgctggtgtcatatactacgccacggtagatacgtccttgccgtgcttttccaatacctcttacatcgtaataagagaaccattcgatgtccgcttcgagtagggcgtcttttacgtcctcgaatttggttttacggataatagcttcaatctttttcatataccttaaatattagtgttgacctgtaaaagaaagaggtatagggtgtggcagccatagtaggttaccatacaacaaaccgataaaatctaaactctaactacctgatccctatacgctctttgatattctatattctctctcttaaaaacttaatccgaatgcgaagtaggctccttctgtccgtggattgacagataccttggcaaatgccggaacggagaaggaatctgtgattttgatatccttggaagctccgagacttacgtctgatacgcagaacccacttgtatagccattgtagaaagttgtctcccaaggaaccatacctaaatctactgtccagtcgagacctcccaatttgaatggtgcgctaagtgcgaggtaagaagaataagcccttttgccattttctttcacgccgtcggcacctgcaaaatttgtataccagttgactgccagtggtccgaagtcatatccgacttgtgcttcaaatacatgagccgttgaatgagctccgtatttaaaatacttgttagttgcaaagatcgtttctccatcatcgtctatgccagtttctacttgggtattaaaccaataatccgtcactgaaacgctaaaaccgcctatcgaataaccaagagttaaatcgaactcttttgtgtccgtcgattcgaatcctaccgatccccatgctccaagtgagaaacctttgtaagagatttccagtgagggttgaacgctcactccgcctaaatcctggccgcgccagatgtaaccacttaccagatctgctccaacggaagcttctaccttatcttgtgccatcattgtagacgggacaagccctgacagtaataatgctactgttattaccctcatttttttgttaatcgtcgttttcatcgtctttttacctttaatagttagaaaaatgtggatgtacggtccatgtatatatagtagcgcgcgaaatactatcaagtaaattgaaaaaccactggttatgaatagactaggagaagttattcaaaattcttatagccagttttttattcttctcatcgcttcgatacagtcgttgcgttcaccaaatgcagttagccggatatatccttcaccgcttggtccgaagcctacaccgggggtaccgaccacattggcttcatacaacatctgttcgaagaatcgccatgacgaaagcccgttcggagttttcacccataagtagggagcgttgactcctccatacactttcagtcctgcggcttccaatccctctttcataatttgggcgttggtcatataatagtcgattgtttctttaatctgtgctttgccttctgcactgtaaacggcttctgcagcccgttgggtaatgtaagaagtaccgttgaacttggtgcactggcggcggttccacaatctgttgagcggtatgcggtcgccttccagagtggcggcggtgagttctttcggaaccacggtatatccgcagcgtactccggtaaatcctgccgtttttgaaaaactacggaattcgatcgcacactttttagctcccttaatctcatagatagagtgggggacattctcgtcttggatatatgcttcataagcggcatcgaacagaatcaatgtatcgtttgccaaggcatagtccacccatttcttcagttccggtttggttaaggttgttcctgtcgggttgttcggatagcagagataaacaatgtctatccgtttgtctggaatttccggaataaagttgttctcacttgtgcaaggcatataagtaacattactccatttgcccgtctcttcttccaacactccggcgcgtccgcacatgacattgctgtctatataaaccggatagatgggatctgtaacacctacgctattgtcatggcgaagaatatcgcctatatttccggtatcgcttttggcaccgtcactgacaaatatctcggatgccgagaaatgaatcccacgtggaataaagtcattttttataattgcttcaatcagaaaatcatatccctgttcaggaccatatccgcggaatgtatccttgctggccagctcttctaccgctttgtgcatggcttcgatacacgctttcggaagcggttgggtgacatcaccgatacccaaccggataatatcctgtttaggatgtgttatcttgaaggtatttacctttttcgctatgtccgagaataaatagcttcccggtaacttcaaaaaatgttcgtttactaatgccatcttgttattgttttaagttctgcaaaatctaatactcaatacctgatacttaatacttttttaatacttatcctcaatctccccatcgaaaactttggttgccggtccggtcattaatatatgcccggagatttcatcccattcaatggtgactgtccctccatccatgattacatcgctttttcttcctgtaagtccgttgatgaaggcggctactgctgtggcgcaagcacctgtcccgcaagcttgagtgattcccgatcctctttcccacaccctcatccgtatggtgtctttgctgacaatctgtgcaaactccacattggttctgtcgggaaaaagaggatgattctccagttcaggaccgatttccggtaaattaatctgggtgatgtcctcaacaaatgtgacgagatgcggattacccattgatactttggtcgaccggaaaggatactttcctccccactgaatctcttctgtttccaacgggctacccatgtctacggtgactgcactaactgtttttccctctacatgcagtttcaggatttttattcctgatcgtgtatccagcgtaatttctgttttgtcagtcaagccgtattcatatacatatttgcctacacaacggcttccgttaccgcacatcatagcttccgaaccgtccgcattgaaaatgcgcatgctgaaatccgctttatcagagacaccaatcaatataagtccatcacttccgattcctgtatgaaacttgctccattcgattgccttctttgcagggtcggctatcggatattggcttgtgtctacatatatgtagtcatttcccgctccatgcatttttgtgaacttaatctttgttgtcattttgattgatatttgttggttgttgtaaccttttgttttattacgatgcaaagatatgactttttgctttatattttactaaaaagtatatctaatatctatttattttcttcaaatttataatcgctttatatacggccacatttagttataatttgaaattatacctatttatatattaataaactgttatttggatgaattgttttgcatattcttccataatatatgaagaatatttagccttgataatcggtgaaatcagctataaaaacaagaaatatatccttttccttttgacgatatgaaagtgaaaacccctatttatctatcatattgctcaccggatatgctgaagaacctttttctgtattcattgttttagcactatcattaatataaaaacgtagagatatgaatatagagaaacaattagaaacagcagttaagaccaaccatttggtgttggtagtattttatgccgactggtcacctcattatgagtggataggtcctgtgcttcggacttacgaaaagagaactgtagaattgattagagtgaatgctgaagaaaatagaacaatagccgatgcgcataatgtagaaacagtgcccgcctttcttttattgcataagggacatgaattatggagacaggtaggagagcttacggtaggagagctgaaagaggtattagatgatttccagtaaatcgtttgtaatcttttattggcatatatgaaaatgaccttttctttttcagatgaaaaaaatgagtgttcttaatatgctggtatttagtttgttataaaagctcatttttcctttaaaagaaacgggtggttcctttaaaagggaccacccgttcgacaccgagaaacatcctgtttcttttaaaggaacgagctgtttctttaaagacggatattaaatagtttactttgtaatgattttatcttattgatgttttttcagttcttcttgtaagatgactggttcgttggtggtaatgaaatctactttctgttcgatcagcgatttcatatcttccacttcgtccacagtccacacatttactttcaagccgagttcatgagcttctttgatccattcggggtgtttcttaatcactcccatgtgataatcaagaccggcagcaccgagttcctttaattctttgggagacagttccccgttaaggtaaaataccggagtaccggcaggagccaggcggataaactctttcatggcatgcagggagaacgtgatatattccatgcggttttccagtcccattttcttcaccatggcaaggattccctgtacggctttggtttcacgtttcttattgctatgtgctttcagttcgagaatcagtcgggtattacagtttttcccggcttccagatattgttccaggctgggtaagttttctccgttggataatttaagtccggtcagtgcgtcacctttggaatactccatcggtctcatcttgtatacaggatcatggttgaccaccaacttgttatccttagcgatccatacgtcaaattctgaaccgtaacaaccgatggaatctgcttttagaagtgatgaaatactgttttgtgatgatcccggagttttccagaatccacggtgggctatcacttttgtctgtgcctgcatacagcaagcaaccattagaagggcagaagccatcatcattttttttaaattcatttgtttggtcttttaaaagtttgatagatttaatttggtttggcctcaaaattataaaaaagaaaacgcaaatcagacaataatatgctaatctgcgttaatccttgagattttaaaatagaaatgttacaaaagaataacagaaagagcagattctgttattcttatcagttaagtataggcctcttcgtgtattcctctcaccgcacgtccgctaggctcattcagattcctgaaagcaatatcccacgccagcgcttctgctgtggagcatgccacactgggaacactgggtacggtgcgtgctgcactttcactggggaaatgctcttcaaagatactgcgataatagtattcttctttattttgtggcgtgttgatagggaagcgttcggcagcatgttccatttgctgatcgctcacagcagcagctgtgatttccctcaatgtgtcaatccatgaatatcctacaccgtcactgaactgctctttttgtctccacgccacactttccggtaacatctcggcaaaggcttcgcgaacaatccgtttctcaatttcctttccggggcacattttagctttcggattcaggttcatggctacgtcgaggaattctttatcaaggaaaggaacacgtccttctactccccatgctgacaaacttttattggcgcggaggcaatcgtacatgtgcaactttgaaagtttacgtactgtttcttcgtggaatgcctgtggagtgggagccttgtggaaatacagataaccaccgaaaacttcatcggcgccttcaccgctcaacaccattttgatacccatcgatttgatgacacgtgccagtaggtacatgggagtggaagcgcgtaccgtggttacatcgtatgtctcgatgaaataaatgacatcacgcagggcatccaaaccttcctgaacagtatagtttatttcgtgatgaacagtaccgatatattcagccacttcacgtgctttaatcaaatcaggagcaccttttagtccgatagcgaaggagtggagttgaggccaccacgcatcactcgctccgtctgtttctatacgctttgccgcatattttttggcaatggcggagatgacagaactatccaaccctcccgaaagaagcactccgtacggtacgtcactcattaactggcggtgcacagcctcttctaatgctattttcacatcctcggtttgtgcatcattctctttgacggtttcatattctgtccagtcgcgcgaataccaacgtttcatttttccctctttactatagaaataatgtccgggaaggaatacttcatattcgtcacaaaatccttcgagagctttcaactcgctgccgaagtagatttttccctctttatcttttcctatatataaaggaataacccctatcggatcgcgggcaatcagaaattcatccttttcctcatcataaagcacgaaagcgaagataccgctgatatcttccaaaaaatggatgcctttatctttgtaaagggcaagaattacctcacagtcacttccggtttgaaagttatattttcccgtatatttagctcgaatatcacggtgattgtaaatctcaccatttacggcgagcacttgtttacgatcgggagagtataacggttgtccgccactctgcgggtcgacaatggaaagacgttcgtgtgccaggatggcacttccgcctacatagattccgctccagtccggtccgcgatgacggatcttctgggccattttcagtgctttatctcttagttctttcgtttgaactttgatgttgagtatacctgctattccacacataactttaatttttagagggggtaatgtaatctgttgattgtttattcgctatttctaagaagctgactagctattcttaattcgttccgccttggtttccctttcgttccaccaaggttatctttccgttctacctgggtgtttctttcgttcgaccatggtggaacgaatcggatagtactaatcaaacttctgctttttccttactgcaaagctatttcgtcagataagcatctatttccgcagcagcctttcgtcctcccgccatggcgcgtaccaccaggctggcacccgtctcggcatcaccggcaagaaatacattctttgcaaatttcggttgctccggtttcaggaatcccatcgccaataataccatatcagcttcgatgacttccttcttccctgttggtttcatcgtgggacgtccgccatctgctgccggaatccatttcacttcttccacttctacacctgtcacttttccattctttccgaggaactgattggaagccaggcaccagcggcgtgtacaaccttcttcatggctggaagtcgttttgaagactgccggccattgtggccaaggagtagccggattgtagccgacaggaggtttcggcatgatttcgatttgagtgacactgacggctccctgtctcacactggttccgatgcagtcggaaccagtgtctccgccacctatcacgagaacctttttgcctttggcatttaccaacttgtctttcgggaaagtctgtcctgccagaatcctattctgttgtgccagcatttcgagtgcgaaatgaatccctttcagttcacgtcccggaatactcaagtcacgtgctgccggtgttccggtacagatgcagtaagcatcgaatccttccggtaaatgattgacgtctatttctactcccatctcaaactgtattccttctgcagccaatatcttcatccgtcggtcaattacatttttatccagtttgaaattaggaataccgaatcgtaataatcctccgggcgcttcatccttatcgaataaagtaacgctatatccttttaaattcagctgattagccaccaccaatccagcaggacctgcaccaatcaccgccactttctttccgtttctttccggcgtctttacttgtatatatccttcacgaaaagccgcttctacgatagctgcttcattctcgcgaatagtcaccggctgatcgcaggaaagtttcaacacacacgatttctcgcaaagagcaggacaaatacgtcctgtaaattcaggaaaatcgcaagtagacgacaatacttcgtatgcctccttccattttcccctgtataatgcatcctgccattccggttgtttatttcctatcgggcatgcccaatgacagaaaggtacaccacaatccatacagcgtgacgcctgcaatttacggctgtttgtattcaaagtctgttctacctgactatagtcagcgattcgctcgtttacagggcggtatcccgcctcttgtcgaggtatatttagaaatgctttaggatctcccatcttgttatttactatttgacgatttactatttactatttctagactatcttatcatttgctatttgactatttacagactatactatacattcaaatagtaaattgtaaatagtcaaattgtaaatctaatagtctctttgcatatctgcaattttttgttgtaactttctcatttgttcttcctgcagtacttttttgtattcgatgggcactacttggatgaattgatctacgtaatgattccagttgtcgagcaggatgcgtgccagtttcgagcctgtgtagaggtaatgctggcggattagttcgtgcaactctttccggtagctggcttcttcgatgagtgacagttccaccatttccatgttacagaaataatcgaagttgccgtctttgttccatacataagctacaccgccactcataccggctgcaaagttacgtccggtttgtccgaggactaccacacgacctccggtcatgtattcgcaacaatggtcacccacgccttctacgacggcaactgcgccggagttacgaacagcgaaacgttctcctacacggccgttgatatatacttcaccgcttgttgcgccataaagcaaggtattaccggcgattgtatttttttcggcttcgaaattgctgcggataggaggcaatacggagatacgcccgccgctcaatcctttacccaggtaatcattcgcttcaccttccagtttaaagttaactcccggtacgagaaaagctccgaaagattgacctgccgaacctttgaattttacattcagcgtatgttccggcaatcctttggcaccatatttcttggcgattactccggaaagcatagcacctattgcacggtctgtattggcaatcgtatattctaaagaaatctctttctcatgttcgatagcttcttgtgcggcatcgatgatggttacatcttttacagcagaaattccatgatcttggtcgatgacatgacggatagccgcactgttgtcaacacgtgccagcaatttggtgaagtcgattaaagcatgtttcggatttgggtcattggcatcggacttgcgctcgattaagtctgtacgcccgataatatcatccatccgggtgaatcccatctcggccaaatgctcgcggacttcctgtgccaggaatgtgaaaaagtttactaaatattcactgcgtccatgaaagcgtttacgtaactcttcattctgtgtggcaactcccaccggacaagtattctgatggcatttgcgcatcattacacaccctaatacaatcaatgccgaggtggcgaagccatattcttcggcacccattagtgccattaagatgatgtcacgtccggttttcagttgtccgtcggcttgcagaactacttggccacgaagtccgttcagaaccagtgtttgctgtgtctcgctcaatcccaattccggtgagatacccgcatagcggatagaagaagccggagaagcacctgttcccccttcagcaccagagatgacaattaggtccgcctttgcttttgccacacccgcagcaatcgtaccgacgccgctttctgctaccagtttcacactgattttggcctgtggatttacatttttcaaatcgaagattaattgtgccaaatcctcaatcgaataaatatcatgatgaggcggaggagaaatcagcgaaattcccggaatggaatgacgtgttttcgcaatcacatcgttcactttaaatcccggtagttgtccgccttcacccggtttggctccctgtgctatcttgatttgaatttcgtccgcattaaccagatattctgccgttacaccgaaacgaccggaagctacctgcttgattgcacttcgtaaagaactgccatcgggcagcggttggaaacgggcagcgtcttcgccaccttcaccggtattactgcgtccgtgaattttattcatggcaatagccattgcctcatgagcctctttgctgatagaaccaaaagacatagcccccgtgacgaaacgatgcagaatgttttccaccggttctacctgatcgattgaaatcggattacgacggaatcccagaaagtcacgaaggaaaataggcttctctttttcgtctaccagatgggtgtactctttaaattttttataactccccagtcgtgtagccaattgcagagtgctgattgtttccggattccatgcgtgcttttctccatctttacggaaagcatacaaaccgttattttttaataactcttcatttttaatactttcaaatccttctttatggaaagcaatggcatctctggctatttcttccagacggatacctccgatcggtgaaccgagtcctccaaaataagccttgctcaattcttcactcaaaccgacagcttcgaaaattttagcaccacgataggagcggatcgtagagatacccatcttactcatgattttaaacaagcctttacagatggatttgatatagttcttttcagcagtggtataatccaactgaatatctttgtcttttaccagtcggtcgaggacagcgaatgccatgtaaggattcagggcacttgctccgaaacccaacaataacgcggcgtgcatcacttcacgtatttcaccactttctacgatcaatgccgtttgcacccgtttaccaactgaaatcaggtggtgatgaacagcgcttactgccagcaatgatggaatggcagcatgggtaatatccacctcacggtcggtcaggacaatgtagtttacaccttccgtcacggattcttccgccattttacaaagatgggtcagtgcttcctgcagtccggctttcccttttgcaacctcaaacaacatgggtagtttgactgttttgaagcctttataccggatattacaaagaatatccagttgggtattgcttaaaatcggatgattcaggcgtaccattttgcaatgactttcactgggcgtcagaatattcataccgactgctccaatgtattccgtcaatgacatcaccagttcttcacgaagtggatcaatgggcggattggttacctgcgcaaattgctgacggaaatagttgtaaagcaactgtggtttatctgaaagtacggcgagtggcgtatcgttacccattgaatggatcggttctgctccggtgcttgccatcggcataatcagcctttcgatgtcctctttggagtagccgaaagtacgaagcatccggtcgtagtttgctacgtgatgaggaactttgcgcccgcttttcagttcatccagttcgattcggttggtagatagccaggtgcggtaaggcttggcttcagccaactgttttttcagttcgccgtcatagtagatctcgcctttttccgtatctaccagcaggattttgccgggctgtaagcgacccttttctttgatgtctcccggttcgaaatccatcacaccgacttccgaagccactaccatcatatcgtttttagtaatcagataacgggcagggcgcaggccattgcggtcgagcatacctccggcaaatcgtccgtcgctgaatagtagtgcggccggtccgtcccacggttccatcaggatggagtggtattcgtagaatgatttcagatcttcactgatcgggttcttctcgttgaaagattccggcacgagcatagccatggcatgtggcaggctcaatcctgacatcaccaggaactccagtacattgtccagagaagcactgtcgctcatgcccggttgtataatcgggcggatttcttttatatcgcctaaagtgggagtggagagtacactttcacgggcttccatccatcctcggttaccacggatagtattgatttcaccgttgtgtgccagcagacggaacggctgtgccaatccccatgtagggaatgtattggtactgaaacgagagtgcaccaatgccagtccgctggtaaaatagctatttgtcaggtccggataatagttgcgcagctgtaatgatgaaagcatacctttatatataatgcttttggtagagagtgacacaacataaaaatcgtcttttgccggaatagatgacaatctgactttattttcgattcttttccggatcagatataacttccggtcggcagtttccgtttccgtaaatccggtgatgaacacttgtttgatgtccggttcgtttgccagagccgattctcccaggatttcggggcaggtgggcacattgcgcaaatgcatcaatgtgagtccttctttttcaatttcttcaataataatacttagaatagctgcctggtctttttcgtttttcggtaaaaacaataatcctgtgccgtaccgtcctttttcggggacaggaataccttgtaataaaataaactcatgcggaatttgaagcatgatacctgcaccgtcaccggtcttgttatccgcaccctcggcaccgcgatggcgcatgttttctaatacctttaaagccgactcaacaatgtcgtgtgacttttctccatgaatgttaaccagcataccgacaccgcaggcatcgtgttcgtatgccgcatcgtacaagcccacctgttggggctgtcgttggtaagggaatccttctgttacgttgttaaaaagttcttgtttcttcattcttactagctttattgtatgataatacctgtttgatgtatcaaattgtttggcaaagttaatattttaatttcaaaatgatagtgaaatttagcttttgtgtgacgcgaaatgagaataggaatctttattcttttaatttgttattaaaaacaggaaatttgcttttaatttgttagcttatttatccttatttgaagctgattgtaatttgtttctttttgagctaaaaataatatattatttaactttttgatgtgtttgcaacttttttatgcgtttctgtcaaataaatatgctttttgttgtctttatgttatttgtaatgtgtatatttgcaggcgaaataaaaatatcataatatgtgtggaatagtaggctatattggtaaacgaaaagcctaccctatccttatcaaagggctgaagcgactggagtatcgtggatatgacagcgcgggggtagcaatcattagtgatgaccaacagttaaatgtgtataagacgaaaggaaaagtctctgatcttgaaaatttcgtcacacagaaagatatttccggtacaatcggaattgcccatacccgttgggctactcacggggaaccttgttctgttaacgcccaccctcattactcttcttccgaaaagctcgctctcattcataacggtattattgaaaactacgccgttcttaaagaaaaacttcaagccaaaggctatatttttaaaagtagtacagataccgaagtcctcgttcaattaatagaatacatgaaagtcactaatcaggtcagtctgttgacggctgttcagttggcgttaggggaggtaattggtgcttatgcgattgcgattcttgataaggagcatcccgatgagattattgctgcccgtaagagcagtccattggtagtggggattggagagaatgagttctttcttgcttcagatgctactccgattgtagaatatactgataaagtggtttatctggaagacggggaaatagctgttttgaatctggggaaggagttgaaggtagtcaacttgaacaatgtcgaaatgatacctgaaataaagaaggtggaactcaacctcggtcagttggaaaaagggggatattcgcactttatgttgaaagagattttcgaacagcccgattgtattcgtgattgcatgcgcggacgtatcaatgtggaagctgataatgtggtgctttctgctgtgatagatcatcgggaaaagctgctgaatgccaaacggtttattattgttgcttgcggaacttcctggcatgccggactgattggtaagcatctgattgagagtttctgtcgcataccggtggaagtggagtatgcttccgaattccgctaccgtgatccggtgattgacgggcaggatgtggtgatagcaatttcccagagtggtgagacggcagatacattggctgctgtggaattggcgaaaagccgcggggcatttatatatggtatttgcaatgcgattggctcttctattccccgtgccactcataccggttcatatattcatgtgggtccagaaatcggggtggcttctaccaaagcatttaccggacaggtcactgtattggcgatgctggcattgacacttgccaaagcgaaaggaaccattgacgaacagcattatctttcaatcgtacaggagttaaatcatattccggaaaaaatgaaagaggtgttggaattgaatgatactttggcggagttatcgaaaactttcacttatgcgcataattttatttacctgggacgcggatatagttatcccgttgctctggaaggtgcattgaaattgaaagaaatatcgtatattcacgccgaaggttatccggctgcggagatgaagcatggaccgattgccctgatcgatgcggaaatgccggtagtggtgattgctacgcagaatgggttgtatgagaaagtattaagtaatattcaggagattaaggcacggaaaggaaaagtgattgcatttgtgacgaaaggagataccgttatcagcaaaatcgctgactgtagtatcgaacttcctgaaacaatcgaatgtctcgatccgttaattactacggtacctctgcaacttcttgcttaccacattgcggtatgcaaagggatggatgtggatcagccgagaaatctggcgaagtcggtaacagtagagtaactttaagtagtaactagtatatagagagatggaacaattgaaacatgaatgtggcgttgccatgatacgcttgctcaaaccgttagagtattacgagaaaaagtacgggacatggatgtatggtcttaataaactctacctgttgatggagaagcagcataatcgtggacaggaaggtgcgggactggcatgtgtgaaactggaagcaaatccgggtgaagaatatatgtttcgtgaacgcgctttaggttccggagccattacggaaatctttgaaaatattcaaaataattttaaggatctcactcccgaacagttgcacgatgcagagtatgccaaacgaactttaccttttgccggtgaaatatatatgggacatcttcgttattctactacgggaaaatccggaatctcttatgtgcatccatttttaagaagaaataactggcgcgccaagaatctggccctctgcggaaatttcaatatgacaaatgtggacgagatatttgcccgtatcactgccattggtcagcatccgcgtaaatatgccgatacatatatcatgttggagcaggtgggacaccgtcttgaccgtgaagtggagcgtgtattcaatcttgccgaagccgaggggcttacgggcatgggaatcactcattatatagaagaatatattgatttggcaaacgtgttgcgcacttccagccgcgaatgggatgggggatacgtgatttgcggattgaccgggagcggcgagtccttcgccatccgcgacccgtggggaatccggcctgcattctggtatcaggatgatgagatagctgttcttgcttccgaacgtccggtgatccagactgctttgaatgttccgtttgaggaaatcaaagaattgcaaccggggcaagcattgttaatcagcaaagaaggtaaaatccgtacttcgcaaattaacaagccgcgcgaaaatcatgcctgttctttcgaacgtatctatttctcccgtgggagtgatgtcgatatttataaggaaaggaaacggttgggtgaaaagttggttccgagaatattgaaagctatcaataatgacatcgatcatacggttttttcttttattcccaatactgcggaggtggctttctacggaatgttgcagggactggacgattacttgaatgaggagaaagtgcagcaaattgctgcattagggcatcatccggatatggaggaactggaagtcattctttcccgccgtatccgtagcgaaaaggtggcgatcaaggatatcaaactccgtacgtttattgccgaaggaaacagtcgtaatgatctggcagcccatgtgtatgacattacatacggaagtctggtacccggtgttgataatctggtgattattgacgacagcattgtgcgtggtactacgttgaaacaaagtattatcggtattctcgaccgtctcggtccgaagaagattgtgatagtatcttcttctccgcaagtgcgttatcctgactattacggtatcgatatggcaaagatgagtgagtttatcgctttcagggctgctgtcgaacttttaaaggagcgggatatgaaagatgtgattgcggctgcctaccgtaaatcgaaagatcaggtgggactgccgaaagagcagatgataaactatgtgaaggatatctatgctccgttcaccgatgaggaaatctctggcaagatggtggaactgctgactcccaagggaacaaaggcgaaagtggaaattgtctatcaaccgttggagggattgcacgaggcttgtccgcgtcataaaggcgactggtattttagcggtaactaccctacaccgggaggtgtgaaaatggtgaaccgggcgttcatcgactatatagaacaaatgtatcaattctaacaaccatacaacgattcaataataagaatgagaaatgtgacattaatccttgacgacgggagccggttttccggtaagtcgtttggctacgagaagccggtggcaggcgaagtagtttttaatactgccatgaccggatacccggagagccttactgacccttcctatgccggacagttgatgacgcttacctatcctctggtaggcaactacggtgttcctccttttaccatcgaaccgaatggacttgccactttcatggaaagtgagaaaatccatgcggaagcgattatcgtaagtgactattcttatgaatacagccactggaatgcggtggaaagtctcggtgactggttgaaacgcgagcagattcccggtatcacaggcattgatacgcgcgagctgactaaggttcttcgtgaacatggagtaatgatgggaaaaatcgttttcgatgatgaaccggataatgtgcctgaagcagtatacgcaggcgtcaattatgtagatcgtgtatcttgcaaagagattatttgctatcttcctgccggaacttcacaaactttctccgtaaatagttcctatgcgcagcttaattctcaattctcaactttcaattctcaatttaagaaggttatcctggtagattgcggtgtaaagacaaatattattcgttgtctgctgaaacgtaatgtagaagtgatccgtgtaccttgggattatgattatagcggactcgaatttgacgggttgtttatctccaacggaccgggtgacccggatacttgtgatgctgcggtacagaatatacggaaggcgatggtaaatgagaaactgcctatcttcggcatctgtatgggtaaccagttgctttcaaaagcgggcggagccaagatttataaattgaaatacggacatcgtagccacaatcagccggtgcgtatggtaggtacggaacgttgtttcattacttcacaaaatcatggttatgccgtagacaataatacgttgagtgcagagtgggaaccgttgtttatcaatatgaacgatgggtccaacgagggaatcaaacataaaaagaatccctggttctctgcgcaattccacccggaagctgcgagtggacctacggatacggaattcctgttcgacgaatttgtaaaactattgtaacaatgaaagaaaatataaagaaagtattgctattaggttcaggtgccctgaaaatcggtgaggctggtgaatttgactattccggttcacaggcacttaaagccttgaaagaagagggtattgaaaccattcttatcaatccgaatattgctacggtgcagacttccgaaggagtggcagatcaaatttactttcttccggtgactccgtacttcgtagagaaagtgatccagaaagaaaaaccggaaggtattatgctggcgttcggtggtcagacggctctgaactgtggagtagcattgtataaagaaggtattcttgaaaaatataatgtaaaagtgctgggtactccggtacaggccattatggataccgaggaccgtgaactttttgttcagaaattgaatgagatcaatgtaaaaaccatcaagagtgaagccgtagaaaatgcggaagatgcacgtcgcgcagcaaaagaactgggctatccggtgattgttcgtgctgcttatgcgttaggaggcttggggtccggtttctgtgataatgaacaacaactggatgtgctggtagaaaaagcattctctttctccccacaggtattggtggagaaatcactacgcggctggaaagaagtggaatatgaagtggtacgtgaccgcttcgataactgtatcaccgtttgtaatatggaaaacttcgatccgctgggtattcataccggtgagtctatcgttattgctccttcacagacgcttaccaataaagagtatcataaacttcgggaattggcaatacgtatcatccgccatatcggtatcgtgggtgaatgtaacgtacaatatgccttcgatcccgaatccgaagattaccgggtgatcgaagtaaatgcccgcctttcccgttcatcggctttagcatctaaggcaaccggttatccgctggctttcgttgctgccaaattgggattgggttatggactcttcgacctgaagaattctgtaaccaagactacttccgctttctttgaaccggcactggattatgtcgtatgtaagattcctcgttgggatttaggtaaattccacggtgtagataaagagttgggttcttctatgaaatctgtgggtgaagtgatggctatcggacgcacttttgaagaagctatccagaaaggtcttcgtatgatcggacagggaatgcatggttttgtggagaacaaagaattggttatttccgacattgataaagccttgcgcgaaccgaccgataaacgtattttcgtgatctcgaaagcgtttcgcgccggctacaccatcgatcaggtgcacgaattgactaagattgataaatggttcttgcagaagttaatgaatattatgaagacttccgaagaactgcatagttggggaaacaatcacaaacagattgccgatttgccgaacgaattgcttcgtaaagctaaggttcaaggtttctccgatttccagattgcccgtgccatcggttacgaaggggatatggaagatgggattctttatatccgcaaacaccgtaaagaggcaggcattcttccggtagtgaaacagattgatacactggcagccgagtatccggcacaaaccaattatctgtatcttacttatagcggtgtagcaaatgatgtgcattatctgggcgaccataaatctattgtcgtattaggttccggtgcttatcgtatcggttcttccgtagaattcgactggtgtggcgtacaggctttgaataccattcgcaaagagggatggcgcagtgtcatgattaactataatcctgaaaccgtatctacggattacgatatgtgcgaccgtttgtactttgatgaattgacttttgaacgtgtgatggatattctggaactggaaaatccgcatggggtaattgtatctaccggtggtcagattccaaataaccttgctttgcgtctggatgcacagaagattaatattctaggtacgagtgccaagagtattgataatgccgaagatcgtgagaaattctctgccatgcttgaccgtatcggtgtggatcagccccgttggcgtgaattaacttctatggatgacattcaggagttcgttgaagaggtaggtttccccgtacttgttcgtccgtcttatgtgctttcgggagctgcgatgaatgtttgttccaaccaggaagaattggaacgtttcttgaaactggcagctaatgtatcgaagaaacatccggtggtagtaagccagtttatcgaacacgccaaggaagtggaaatggatgcggtggcgcagaatggagaaattgtagcatacgctataagtgagcatatcgaatttgcgggagtacattccggcgatgcaacaatccagttcccgccgcaaaagctgtatgtagaaactgttcgccgtattaagcgtatcagccgtgagattgccaaggctttgaatatctccggtccgtttaatattcagtatctggcgaaagacaacgatatcaaggtgattgaatgtaatctgcgtgccagtcgttctttcccgtttgtcagcaaagtgttgaagatcaactttatcgagctggcaacgaaagtgatgctcggtctgcctgtggagaaaccggaaaagaatctcttcgaactggattatgtcggaatcaaggcctcccaattttccttcaaccgcttgcagaaggccgatccggtgttgggagtagatatggcttctaccggtgaagtaggttgtatcggtatggatacttcatgtgctgtattgaaggctatgctttctgtaggctatcgtattccgcagaagaatatcctgctttctacaggtaccatgaagcaaaaagcggatatgatggatgcggcccgtatgttggtgaataagggatacaaactctttgcaacgggtggtacacacaaaacgcttgcagagaatggaattgaaagtactcatgtctattggccgagtgaggaggggcatccgcaagcattggagatgcttcatcgcaaggaaatcgatatggtagtcaatatcccgaagaatctgacagccggagaattaagtaatgggtataaaatccgtcgtgctgccattgacttgaatataccgttgattacgaatgcccgtctggctagtgcatttatcaatgccttctgtacgatgagtgtggatgatatagctatcaagagctgggcagagtataaataagcagaatgtcatctttttgaaaagaggctgacatcacattgaaatgaaaatggtaaggccgttcctgttattcgggagcggcctttgttgttgtaggactgtaaccgaacttgtcggagctgatatggtgaaagggattgatggtatctcttatttgcctttgttgacaggaaacggtgaagtatctcgtagccatgaatatatatactatgagttttatgaacagggaggaaagcagtcgattctgaaagatgggtggaaactggttcgattaaatatgtcgaaaccggaaaagttgaaagaagagttatattatcttccggatgacataggggagcaacatgatttattgaaagagaatcctcaaaaagtggaagaattgcgaatattagcaatgaaggcacgaaccgaaagcctgcatttcagttggaaaccggagaagtaatgtgaatcagaaaagcagaggaaggcagacaaaagtggaagagggggctgccaggatgctagattctaccgaattatgacaaaagtgttctgtttttcttgtagatttggacattttgaagtaccttgcacacctatttcaaagaatatttttttaacaggagaataacaggtatggataatcatgttgtaataatggctggtggcatagggagccgcttttggccgatgagcactccggaatgtcctaaacaatttattgatgtaatgggatgtggccggtcgctgattcagttgacggcagaccgtttcgacggtgtttgccctagggaaaatatgtgggtcgtaacttctgaaaaatacattgatattgttcgggagcagttgccggaaattccggaaagtaatattttggcggagccttgtgcgcgcaatactgcgccctgcattgcttttgcttgctggaagatcaagaaaaaacatccgaatgctaacattgtagtaactccttcggatgcattagtcattgatacgggagaattccgtagagtgatggagaaagcccttcgtttcacagatgatggcagcgccattgtaacgataggtatccggccaactcgtccggaaaccggatacggatatattgctgctgccgatcagctccagacagataaagaaatttacaccgtagatgcatttaaggaaaaaccggataaagagactgccgaaaagtatctggcagaaggcaatttcttctggaatgcgggaatctttgtatggaatgtgcgtactattacttccgtgatgcgtgtatatgctccgggcatcgcacaaattttcgatcgcattttccccgatttctatacagagaaagaaaatgaaacaatcaagaagttattccctacttgcgaaagcatttctatcgactatgcagtgatggagaaagcacaggagatttatgtacttcccgcttcttttggctggtcagatctgggtacatggggagcacttcgcggtttgcttccacaggataagtctggaaatgcaaccgtaggaaccgatatccgtttgtacgaaagcaaaaattgtattgtgcatgccagcgaagaaaaacgagtagtcattcaaggcttggatggatatatcattgcagagaaagataacacattattgatctgcaaattggaagaagagcaaagaattaaggaattctcgaaataaattttatttcgagaattgatattcatgtggtgtcattcctgtcattcgcttaaagaacttcgagaaaaaagaaggattagggaagttcaactcatcagaaatttgataaacaagcagattgctatgttttagcaatactttagcttctaatataatggactggtttatccagtccattactgtttgttgactggtttggcggatgatagtattaagataacgaggagtgagacatagcttatccgcataaaaactaacattacgttctctcttactataagcattgactaaagaaatgaaacgctggaaaatctcttcctgatgtgtctgacaactctgttctttttgattgttgtttttgacaagatactctatattgcacaaaagactgattagtagatattgaatagcttcccgtcggaacgttggttcttgtaatatattccatattaaagcaaagtagctcttaaacaagccgtattcatgtgaggtcagagataatatgaggtttttctgtaactgtgaaagatgagtgaagaaattgtcttttccggctatagaaagaaattctgcgtccatgcctaccatctgcatatcaaaatccggagagacttctataatctgaagaatggaattcggaacaattaatagtagcttgtccggctgaaaagtttcttctatcaggttgattaatacgcgtgcatatccctgtttgataactgcgatacgtccctctttgatacgataaggttgatctattgtgataagattggattctattttggcgaagctgtttacgaatccgaaatgcggagatatgaaacgaaattcgttaaatcggacgatatccggattttctaagatttcgagacctatatttaatggtattttcttttccatctttatctgttttttccgccaaagataataaaaatcagcaaatagccttttattctttctctttatcgaactattggaacatttttactaactatcggaatgtgaacgtatctttgaaacctctatctttgtcttttgaagaaattaaagaaatgatgtgtatgaaaagaatggttttcagtttctcctttttattgtttgtatcgggaataaatgcgcagataacgttggaagaatgtcaacggaagacgcaggaaaattatccgttggtacatcagtatggcttggtggagaaaacaaaggaatataatcttgagaatgcggcaaaaggatatttgccacagtttgccctttcggctaaagcttcttatcagagtgaggtaacggaaattccggtgaagcttcccggagtggatttgaaaggagtgccgaaagatcagtatcaggtgatgttggagttacaacagaaaatctgggatggtggaggaatccggatgcagaagaaacaaacgactgcggaagcggagatagagaaagaaaaactgaatgtggatatgtatgcgctaaatagtcgtgtaaatgacctttattttgggattcttttgttggacgagcaactgaaacagaatgcattgttgcaagatgaactggagagaaattatcgccagattactgcttacgtagaaaatggcattgccaatcaggccgatttggatgctgtgaaagtggagcagttgaacacaaagcagaaaagagttgaactggtttcatcgcgtatggcgtatttgaagatgctttcacttttggtaggagagaaattgtcgcaggaaacggttttggagaaacctgttcctcaagatgacatttcggctgtcggtgagattcgtcgtccggaattatctttgttcaatgcgcaaggagtaggattgcaagtacaggagaaagctttgaatgtgcgtcatcttccacagttcggattattcgtgcagggagcttatggaaaccccggattgaatatgctgaaaaatgaattttctccctactatattgcgggtgttcgcctttcatggaattttggtagtttgtataccttgaagaatgaccggaaggtaattgaaaataaacgccggcaattggataataaccgggatgtgtttctgtttaatacaagattggagatgacacaacaagatcaggccatccaatcattggaaaagcaaatgcaggatgatgatgagattatccgtttgcgtaccaatattcgcaaatcggcagaggccaaagtggcgaatggaacattgacggtgaccgagatgcttcgggaattgaccaatgagagtttggcacgtcagtcgaaagcgctgcatgaaattcaacggttaatgggaatttatcaattgaaatatactacgaatgattaatataacttctttagatatggaacgaatgacaaagataggaatgtatggagtggcattgattatgttggctgcttgtggtaagggaatacccggctatgatgcaaccggcacgtttgaagccacggaagtgatagtctctgccgaagctgccggaaagctgttgcgactggaggtagaagagggaacaagactgaaagcaggtgaggagattgggctggtggatacggtgcaattgtatttgaagaaattacaactggaggccagtatgaaatcagtggaaagccaacgtccggatcttgctaaacagatagctgctaccaaacagcaaatagcaacagcagaacgtgaaaagaaacgcgtggaaaacctgcttgccgctggagcggcgaatcagaaacagttggacgactgggacgcacaagtcaaattgcttgaaaggcagcttgtcgcacaggaatcgtcattgcagaatagtacgaacagcctgatagaacaaggaaattcggttgccatacaagttgcacagatggaggatcaattagctaaatgtcatgtccagtcgcctattgaaggtaccgtattggcaaaatatgcagaagccggtgaattggcggcgataggtaaaccgctgtttaaagtggctgaagtggatcgcatgtatttgagggcttacattacctccgaacagttgtcgcaagtgaaactgggagatgaggtaactgtgtatgctgattatggaaactcggagcagaaagcttatccgggggtagtgacctggatttccgaccgttcggagttcactcccaaaacgattttgacgaaaaacgaacgtgctaatctggtatatgcagtgaaaattgccgtgaagaatgacggagcattgaagattggtatgtacggaggagtgacattgaaaaattaatgattaaaaattaaaggagaggagatggaaaagggagaacccatagtggttgtgaaagaagtcggcaagaactatggaacagtggaggcgctgaaagaagtttctttcgttgtggaacggggagaaatctttggtctgatagggcctgatggtgccggtaagagttccttattccgtattctgactactttgttgctggcggataaaggaacggccatggttgccgggctggatgtggtaacggattataaacagattcgtacgaaagtgggatatatgcccggtcgtttttcactttaccaggatctttcggtagaagagaatctggagttttttgctaccgtgttccatacgacagttcaggagaattatgatttaattaaagatatctaccaacagatagaaccgttcaggaaaagaagggcaggggctttgtcaggtggtatgaagcagaaactggcattgagctgcgctttgattcataaaccggatattttatttctggatgaacccactaccggagtagaccccgtgtcgcgtaaggaattctggcaaatgctccgaaacttacgggaacaggggattaccattgttgtttctactcccatcatggatgaggcccggcaatgtgaccggattgctttcatcaatcatggacagattcatggcattgatactcccgaacgtattcttcatcaatttgcgtctatcctttgccctccttccttggaacgggaggaagtgaagcatgaagtagctccggtcattgaagtggaacagttgacaaagtgttttggagattttaccgcagtagatcatatctcctttctggtgaaccggggcgagatatttggctttctgggtgctaatggagcaggaaagacgacagctatgcgtatgctttgcggattaagtaaaccgacatcaggcatcgggaaggtggcaggatatgatatttaccgggaggccgaacaagttaagaaacatatcggatatatgagccaaaagttttcgctatatgaagacctgaaagtgtgggagaatatccgtctgtttgccggaatttatggcatgaaggaacaagagatagaacggaagacagaagaattgttggatcgtttggggcttactgccgaacgggatactctggtgaagagccttccggtgggatggaaacagaaattggctttttcagtatcaatattccatgaaccgagaatcgtttttctggatgagccgaccggtggagtagatcctgctacgagaagacagttctgggaattgatctatcaggcagccgatcagggtattaccgtgtttgtcactacccattatatggatgaagcagaatattgcaaccggatatctatcatggtggacggtcagataaaagcacttgatacacctgcccgtctgaaacaacaattcagtgcggaaacgatggatgacgtttttcagaaattagcccgcggtgcggtgcgcaaagcagattgattatgagacagtttatagcttttataaagaaagagttttatcatattttccgtgaccggcgaaccatgctgattttgttggggatgcctgtcgtgcaaattattctattcggttttgctatcagcacggaagtgaagaatgttcggttggcggtgctcgatccttctaatgatgtggtaacgcgaaaaataattgatcgtttggatgccagtgagtatttcaccgttactgcacgttttcattcgccccaggaaatggaagctgctttcctaaagaatgaagttgatatggcgattgtctttagcgaacggtttgcggatgatctctatacgggtgatgctcgtgtacagctgatagtagatgcaacagatcccaatatgtcgacttcgcaagttaattatgcgacaggaatcgtttctatggtaggccaggagatgattcccccgaatatgtcggctgcccgcctgactcctgatatcaaattgctctacaacccgcagatgaagagtgcttataactttgttccgggagtgatgggcttgatcctgatgctgatttgcgccatgatgacctcgatttccattgttcgtgagaaagaaacaggcacgatggaagtattattggtttcacctgtgaagccgctatttattattttggcaaaggctgtaccttattttgtgctgtcgttcgtcaatctgataacgatccttttgctttcggtctttgtgttggatgttccggtggtaggaagtttgttctggttaatcacggtatctttgctgtttatcttcgtatcgttggcattgggcttattgatttcatcagtcacacgtacacaggttgcggccatgctggtttccggattgatgctgatgatgcccacaatgcttttatcgggcatgattttccctatagagagtatgccggtgatacttcaatggatctcggatatacttccggcacgttggtatatacaggctgtgcgtaaactgatgattgaaggagtaccagttgcattggtgtataaagagattggtatcttgttattgatggcgacggtacttattacgatcagtatcaagaaatttaagtatagattggaataatatgtcgatatgccaattggctgtatgaatactatacagtgtgctaatgggcagattgataaatggaagaattatttatgataaagttcctgatagaaaaagagtttaaacaattgcttcgcaattcgtttcttccgaaattgattcttgtatttccatgcatgattatgctgctgatgccttgggcggtaaatctggaaatcaagaatatacagctgaatattgtggataatgaccattcggctatttcacaacgtttagtcaataagattgccgcctctacctatttccgtctggtggaagtgccggcttcgtatgaagaaggcctacggaatattgaaattggaacggcggatattgtgatggaaattccgcggcatctggaacgggattggatgaatggagaagatacccacatactgatagcagccaatgctgtgaatgggacaaaaggagggctggggagttcttatctatcttctattattaatgattatgcagccgagctgcgttcggaatatcctacaactgctacagtctccggtgctttcccttcgataggcattgatacacaggggttgtttaatccgaatctgaactataaactctatatgattccggcattgatggtcatgttattaactttgatttgtggtttcttgcctgcattgaatatagttagcgagaaggaagtaggaacgattgagcaaatcaatgtgacgccggttccgaagtttatctttattttggcaaagctcttgccttactggttgattggttttgtggtgctgactgtatgtttcatattagcctggttaatttatggcatagtgccggtcggtcattttctattgatttactttttcgcagttcttttcgttctggtaatgtccggtttcggacttgttatttccaactactcggcaacgatgcaacagtctatgtttgttatgtggttctgtttgttggttgtaattttgatgagtggtttgtttactcccattagcagtatgccggaatgggctcaactaattactaggctcaatcctttgaggtattttatggaagtgatgcgaatggtgtatttaaaggggagtggtttctttgatttactgccacagtttggagtattgttgttttttgcagtagtgtttaatagttgggcagtgattagttatcggaagaataactaaggataatgtagtgtactgaataagttgacacttctcaaattcgaaattcacatggaagaattaaaaaagaagtacactccttacacagaatctgaacgaatgtcttatattcgtgagtatttatcgacttccgaaacgaagtatcagtttgctaagcgtaccggtatttgccgacgtctgctgattctttggctcgaaaagtatcatataaatgataaagttatgaatacagaacagccctctttaagcaaagcctctgatgagtctctcaatgaactggaaaaagaactcgctgcattgcgtgccgaaaaccgcaaacttcagcgtgcccttcaggaggaaagtcttcgtcatgaagcttgtgaggaattgattaatcttgcggagtccacctatcacatcaaggttcgaaaaaactccgatgccaagtaatcgacaccttgtcacaggggaactctgcccgtcatatgcgcggcagtctgcagttcctctgtgattacttcggcataaccagacaaggttattataagcatgtcaacagaaaaaaggaaatagacatcctcacatcaagcattgtgctgtattgtaatgagttacgtaaacttatgcctaaggctggtatgcgtgaactctatgcatgctgcctccgcaagtttggtgtcaggatggtcattgggcgtgatcaatgctataatatttttcgtgctaatggcctgtgtcaacgtgtcaggcatgtgagaccaaagacaacaaattccaatcataattattacatttatccggacttgctgaatgtcactcctaaatttgtagctgacacattcggttcaatggttgtagcggacataacctatgttgccacgtgccagggatgggcttacctgtctcttcttaccgatgcgggcagtcgggccatagtcggatatgcactgtgcaaaacacttgaagcggaaggtcccttaaaggcacttaggatggctatggacttttacaacagatacaatgttgatttgagtagtctcatacaccattctgaccggggagtgcaatactgctcaaaactgtatgtgggcatgctcaagaaacatcatattaatattagtatgactcagtgtggagatccgctacataatgccctggctgaacggatgaataacacgatcaagaatgggtggctgtttgactgcgaagatgatagctttgaacagttggataaacgtatagccgatgccatatatgcatacaattatcttcgaccccatcaaggcatacaaatgaaaacaccgatggaatatattcgtaacggcaggggaaaggtagttgaagtcccgctcgtcgggacgggtgctcccgcccctattcttatggattacgcaagcgaattttgataatttctcgaaaaaaaagcatccagtttgtcaatgacggacaacttgctattttttgattttatttcgaactcacgttatttatattgccggagatacggaggatattccggaactaaaccaagtgaaagatattgatatcgcttttctgccggttaaccaaccatataccatgacaccggaacaagcgatacgggcagccaaaatcatcaagccacgtgttttgtacccttatcattacggagaaacagatatccataaagtaaaagacggattgaaaaatgagacaggcacagaagtacgtatccgggctttgcaataagatatacgtaaataatcagaaagtggctgaaaatatactcacctgaatatccgaaaggaccttgaataaagtgcactccaaaagttagatctaaaacttttggggtgcactttaatatctcaataagaatgattttcgcttcaagggctttccaaacattcagtcccttataaagagcttttccttttttaatcagttacttccaatcacacagcctcggcagacaaactggaaatcactgtatccacccaatatacaactgttctatccgccggcaaaactccttccagataaggtgaatcggatacctcctccaaccatgccgtagtaatcggtcctctttctcttgtagaactttgagttcctaaatacggactaaaattaaaaaacgtgtgttgttgctctacattatttttatctatatatgtaaaaacaaaagcctttttctgttttccacccaatgaagcccactctatctggtatgttccttcaacaagaatttgctcatcctctgtcttataaatgaatttccctcctgttccttcttcagataaatgatatacatcatccggccgcaaaatgcagatatctcctttatttataaaagaataaggagccattgccacatttactttttcctgcaactcgctttccgaatccaatgacaacatatcttcactgggtctggaaacctgaaattcaggttggtcgacgcacataaatgtcaatacgccataagaaacagtcacaggcagggtgacataattaccatccttatcagtaacggtaaccgttactttcccttttttaccatgcgaactaagccataatcggttgtcgatgactgttgctgtcacaattgtttcatcggagctttgtgcagagtagccaccttttccattggctatcccgatattctccgcttcccatccgttaagatacaagactgtagaagaaactgtgtttgtacaagttcctgtttcgtcaaccagttcggaaccactaaataagataatctctgcatcatcttgacaggctgatacacaaaaagccataacagaaagaagaaagaagcctaataaagtttttgttttcatattttcagtggtatggttaaatcccggcatatgccattgttttgcaaagatataaagtatttgtaaaaaacactatctttgtatgaaaagttaccaatagtacagatccactagattcttccatacagcgtaagttatatgagatatacaacagaaggtcgttgaaaaggacgttcccgggggaaaaagggaatgggaaatacgggaacgtcctcaaaacataacaatacagaaatatggactttcacaagggcgcatttctgtctctcttatgcaacattcccttctataaaaatatggaggaaatatctggagaggatattattatgtgggaaatttagtttatagtcttaaaagcaatctgattgcatcaaagtgatgaacgataggcagtccgaatatattctcctactgcattgtcatcattgatttctatgtattttttcaataaatccgcaaatccggattttatctgttccgtttgcttgttctcgcaggctgtagaatattcatcaacagccatgagaaaatcctgcattcgttcattcagcattgttcctcctgtgcaaaccacatcggaaatataggcttggatactaccattttctatgacaacagggaggcggtattccagtcccgatttgccggcacgaatagaaagcacttttactacgggcgacacaatagtcaccgtatcggaaaaatcaaactttccgtggactatttctgcactatctaccagctgcccgctcgaaaaatctttcatataaaccatttttccttcgaattcgggcaaaggtgtactaccgttaatctcgtaaccttttatctgatgcccggtgcaagccactatcagacatattcccggaagaaaagataaaagtttcacatatctgttcattaagctcttcattcttctttaaaaaagaaaagccgtccgcactatcagctgaacggctttctcttttcattcatacatttgtataatcattcatccttagaatctgaatcccagtttcactacaggcatttcaaatattttgatattgtggtgactggcgttatatttatcaaatcctttcgggcaaatctgtatcaagtcatagcggtaagccagagggtgcatttcgaaaccgaaaacaaaacctttggcaatgctatactcaatacctgctacggcagctactttgaaaccgtacatctgaccggctttacttccggaaacatagacctgtgacggaagttcttccgagtcgtcactatccttataggtgtctccggtgtatggttcggttgtttcaatgcgtgccatctggaagccgagtgcgcctccaagatacggatgaatacgttcgttgcgagtcttgaaatagtagttggaaccgacagatacataccagttgttagtcatctgtgcattgatataactttgcgcagggataatcatgtcgggtacactgttgtctccttctacatagtctttcttaggagtgaggctgacgttcatgctgaactggaaatttacatcccaattgtcagacacaaaatacttaccttcaattccggctatattgaccagactattattattcagactcccgatgttcagatagcggttcagatcgccggagttatccgtccctccatttggaagtccgactactcctccatcattggagaacttgggaagcagataagaagtgttttcattaaaaaactttccgctaccaagcaggactgaaacctgccactgtcctttcttcgggacaaacgacgcatcatcactgctgctgtaacgctgcgccattgaaggcgcagctgtcatacaggtcagcaaaagtaatgtgcatagtttttttatcatcttgttacttttacgtagttagggaattatttcaagaagatagcaagaagtgctttcaattgagcgcttgcagcatcatagtctgccttggcagcatcatattcagcctgttttactttgatattttcctgaatacttgccaatgattcagtaatataatctgtatcagtataagtacctgccgctaatttctctatatttctcttagctttagcaacatcggccttagcggcagtgacatttgccagagcaatcatgtattcttccttaaccaagtttttgatagcttccaaggaacctaaatcaccattagtaaagttattattcaaataaacagtgatttccgtttcaatcttacctttgataatttcattattgccgtattctttttgtactgtttcaatattatcatttacttctttaaagactttatcataagcagcctgggcttcgtcgttagctttcttagctttatctacagcatccgccaaagcagcatttgctttatcttgagcagcctgctctacagctttttgagcagtaaatgcttctttcaaagctttgtaagtttctacctgatcaattatagcctgtagactagccgtttctgctgttgcccaaatcatcttaccaagagaaccataattaccattcttcaaagcgtctacatggttaccaccagccgcagctattacttcgtccttagatactggcaatcttcttggattattacctgaattgaaattatcgctaaatacagcagaagaagcagatttccacttttccaatggagtctttacactggaatcttgctctacatctattaattttccaatattttctttactaatttcatttgcagtagcaatgtcaccagcatcccaaatgataaagcctaaatctactccaacaacttttttaaagttatcagcgtctgctatcaaccaagcagagatttttttcgtatcacttccttttgttgcagttgccttagtaacttgtgcttctttagccaatgcatccttatagtatgcaactaaagccgtagctacagcatcaatattagcttctttttttctatcttctggtttaagtccattatatttctttattgcagcattagcggctgcctctgatttctccaaatctattttcagactttcatcataagctgccattgcatcttcccatgctttataatctttagcatagttctcttctgcttctttttgtgctgcaagagctgtagccaattgtggtttggcccattctatattttccaaatcaacacctttagtagccttatcaatcagcttaacccaaccatcaatctgactttgtgcttcagtaatttgtatacctttagcataggcaaaagtaccagtattagaattataaccagcaacagttgttccaccagatattgcatcatttaatcctttctttacactttcagcctccactttcttagaataagctgcagctgttttagctttgttcttgttagagttctggttatttttagcagtctccaacttattgctagtagcttccaagtcagatatcagtttaggattagcaacttccagcttacctttttcaatattatattgttgttccttgacttttgcagcagcaatctcttcttccagcttcttgacttctgcttcccaatctgcaacagtagtatactcattatccaagatagctttcaagttatcagcatacttctgcgtcatttctaaagcaaattctgcatttttcaatgcattatccaaaaccgcttctaaattattatcagctactatatcagaatagttagctaattgctcctgaagtttttttaagctaccggctttatagccatccacagactgggtaggatcttcagtaataagataaacataatacttagtcgtagaagaattagtctccgtgctttcatccggatttgtagtagtagtggaatttgcaacttccgatgacagaattcttttgataacagttgttgaatatccatacattgccttgtccattgcttgttttgcataggcgacttgcgcttgtacaccattcaaacgagcttgttcttcatctgtcagcaataacttggaagcttcaatctgttccatagcttgcttgtaagcttcctgtgctttagcagtgacagtttcggcaagaagcattttttccttatactgctcaacaatcaatgccttttcattttcccacttagttttgtcagcttccgcttttgcaatggcagcttccgcttccgctttagcttgtgcagtagcagcttcttccttttcaatcaggagttgcttcaactgaatattcagttcatgcaactgcaaatcaatttctgcagatttattctgaagtgccaaacctgcattaactaactcttgctctgcaacctgtgcttttctcaattcagcctctacaagctcaactgcagcttgagctttgataaaatcagactttgctcccctaagttctgcaatgccttccggttcatcggtatcaatacatcccgtgaatgtcgccgtcgtacctgccatgagcaaggttgcgactaaatacgtccattttctcataaaagtaaattaaatgttatacaattaataaataaaaaatttgtttgtactaattcatgatttatttcgcttcactccccctcttcccgttactttgtaggtaacgggaaaacccttgtgcctgctcttttggagtagtctatactagaaaataatacgatatatgacgaatcttcttacccctgcttatgagaaaaagtagaggggcgggaaatctattgcaaaatttagacgttaacaaagctctaagacaaagaatccacgtgttcttctgtgtttattcctattttgagtagtttattagaaaaaatgtacgattttgtttggatgttttaagaaatatgctcatatttgcagcgtcttttctccccgttacctacaaagtaacagcactattaatcagttacttgccacaaatatagttcctcttcagcgaagatagaatcgtcacattcgcttcatctattttcttattcttaaaaggttttagataagtctctgtgacgataatagatgaatgtcccatcgcctctgaaataatgcctggatgtatctcgcaataatatgccattgtagcccaagtatgccgagccgtatatgagcttaaatcagaagtcaatgcaagtacttgtttcagcaacagaagctgatagttaaaattacgcaaagctatctgatattccctgtaggtagcttcggtactttctccgccagtcagtatgggaaaaagataaggagaagcagaatcggtgttcatatacttttttattagtttcatagtttccggcagaagcgtcacagttagaagccgcccggtttttctacgacgataagtaagcacattccccaccatatcctgctttttaagataggcaagatctacaaacggcataccacgaagcatgaacattaagaaaaagtacgcgcgcgtacgttgtaattcttcccttccctgatgaatttgtttgggaagctctttcatcaatcgttccatatcctccttttccagtgcacgctttctgtcagcacgcgttcctgtataaacataccggaaatgatgcggtatataagatgccatacgacggtcaaccgcgcggttgtacaccgccctcaatgtacgcatataggttgaaaccgtgttccaactacaatccttttcccgcaaatacgtttcaaaacttttaagaaactcctgattcactttcttgaatgacagattcctgctcccattaaatgcaatgatagcattcatgctactcctgtaaacatgagcagttccataattcccactttttcgaagcccttcagctacttccttcataaatgaaatcaaattccccatttttattaattttagttatcactcaagcacatccctgaagaaaagcgccctcaccgcaattccccccaatgctcttaattcaaaatctcaaagtatcatcatacaaatatgatgaattatgttttctttatatacacccgatgtgttcctctgccatcaatcccgataccggaaccgggcgtatacgcccattggcgcaattcattggtagccgccgtgcgcagcagacctgtcagtttccggtattcgtagaccgtcagaaaaggatgttcctccagatatctaacagccaatgctagtcgttgctccggtgtatacttctgtgaagagcgttgcgacttccacggagctctttccagcagacatcttccgttgatacgcctcaccatcttcctgtctacacgaaagttcacgctccccaccacaatgcttcgtgcgttacgatgggtttcaccctctccggtcttttcgcgttctttatctttgcataacgccaacgaaggagagaatgttccgataccatccagcttcacagacttgccttctgccatctgatgtgccatttcaataccgatctgtgtaattacgccttccacatctccgacattaaagccactgctggatgctatctgacgtattaaatcctcggtagatacctgatctatcattgcaaaccgaggataaagtacctgttcgcccgttccatgaatatcgggcatttcttccattacgtacattgccataatactaaagtttatttgaaatattgattattaatagaaaacttactcgctataggtagaaaacttgttctcccctacaggaaaagttgtttttcctataggacaaactaaaaccgcaagttctggttttataactgaaacttctgattacataatcaaaagttccggttttataatcagaacttgcggttatagttttcttaccaacaaagatacgttttcctgccgggataagcaagtttaatccctatgaaaaagaagtttgattacaattcagttacttatcaccgtttctttactttatatcctttcagggtaaaaccaacttcaaacaggttcaaaagggctatccggatgttatcttctatataggtctccatattatcatattttgcaaagttgacgggaaggagtctgttattcctcctaaagctttcatccggtattttaccggtaaaacgtcctttcttcttcactccccaacgaatggttttactacaaggaagaggtatacctatcgtcagcactttttctttagttaccgtatcggtgattccatgtttccagatactgatatggttggctcccaaataagtgccgatataaaggacaacggtcagcgtccaatcgtccaaagcctcatcggtttgaataccattcaccaaatcagagaaatagccttcaaccatttctctgtcaaaacagtttagttcaggccattcacatttctcaaacagttgatgcacattgacaggaaccagtaaggtggttatttctaactgatatttcattcatttcgtttttatatcattgcatctaaaatcgtctcaagtatcttatcgactataaatatacaattttaccagatcaaatgctaaagagtagaactttttttaaacctatttctgaaaaagaaaggactgtttgatacacccctcctatataaacagggtttatcagacagtcctttccgtgcggagtatgattcgtccgttattcagtggacgatccttgcttttcgtccttacggcatttcagtttccatctggaacttacggcttactttcatcaaattgatagtgtaagtgactacgttctgtgcttcctgaaccatcgtgagatacaccatgcttacccggatgcttcctgattggctttggatgcgttgcagttccttacgtttcaatagtgaaagctgtccgttgaggtcgttggcacgacggatttcttcttcgaagtcgttgtactcgttgttttccattttcttacgacactgctgaatcagataggtgatatcttcggaaacatcgctgaattcacctttctggatggcgtccaatgggttgaagttgttgtcgatatgttcgaggcaaggttcgcagaggcgggaaatactgtagaccaattcgctggcgaagtcgttgccttgatagtaataaagtcctttttcgagtacggtgttattgtcgagacgacacatggcgacggtgcccgaacgtttcatctgtttgatgagctgtttctcaaatttagtggaccccatggcacgacgcaatcctcgcagattttcatgaaggaatgaagtgacagtcagttcgaaatttgtttctgcatattccaatactttggaaagttcttcgcgggtgtgcttacgcatcagttgcagggcttctgtgctgtctgtggtttgcatcagttgcttcagcgtttcgttaccttgttctttcgctttgcgtttcttgtacatcacctggctacggatcaagatgaatacagctataccgatgagggcgatgatagagatgttacctccataatggagtacgagagctacgaagaaacagatggtgaaggcggctccggcggtgatgaaccagcctccgatgacgcttaatacgccggtgatacggtaaacggctgaatcacgtccccaggcgcggtcggccaaagaagtacccatagctaccatgaaggttacgtaggtggtggaaaggggaagtttcagggaggttcccaaggcgatgagcagaccggccaataccaggttgacagaagcgcggacaaggtcgaaagcagctccgtcggcaatgattgcttcgtctttgcggaagcgggagtcaagccattttttgctgccgtccggcattattcgggagattccattggcaagtgtcatgctgatgcggactactgtgcgggcgatcggagtacttccgaatgcttcttctccttcatcttggcgggaaaggtcgacagatgttttaattacagcatgtgcttttttagaggtgcagagggcgtagaccatgacggctccggctccgataagaaaataccacggtgttttagcaggtcccagcaaggaggtcatcaggaagccgttcggatttccttctccgttggcggtgtaatctaaaaaagaggagaaacctgcgaggggaacgccaataaagttgacaaggtcgttaccggcaaaagcgagagccagagcgaaggttcccatcagtacgacgactttgaaaacattgattttcatccagtgaaggatttgcatcagtacggtgaagaatacaaagaaaacggtgattagcatcagtgtgttgtcttgtatccagtgtttgttttcagaggtcatgaaggaactgtctttcagtcctttgataagcatgaaatagatgatagcggtagcggctacacctccgaagagggcaatgctgtatttcatctttttcgtatagttgaaagtgaatatcacacgggcaagccattgtacaagcattccgaagaagaaggcgatagcgacggagacgaagatcgccatgatgacggagagggctttgtcggtgtttatgaggtcgcccagaccgagggtatcgctattatgtactttgataagtgagagggcaaaggtacctccgagtagttcaaagactagtgaaacggtggtagaggtaggcatccccatggagttgaatacgtccagcagtactacgtcggtcaacatgacggccagcagaatgcacatgatttcggcaaagtagaagtgctcgggctggtagatgccgtgccgggcaatgtccatcataccgttggacagggaagcgccaatgaatataccaataccggctatgaaaagaatggttttaaacgaagcggccttggcgcctaccgcagagttcaaaaagttaactgcatcattactgactccgactatcagatcgaaaacagctagtacaaagaggaagatgataatgcataaataaatagtctccataataaatatatgtgtatgttgtttccggctgcaaaggacgggatttgacgttgcagggaggtgtcatacatgttacatttatgttacaatcgtctttcttttgtcttgaaacaaaagaaagaagcaaagaaaaattcaaggctgacttttttctcctactcgctccctgcactgcgctaaagggcagaaactcgctacgctcaaacagtctgccctttttgacgctccgttacgggggctcgcttgacggagaaaaaagtaggccggaggggcgtgcggggtgggcgttgtgggggaggttgcatgagatgtcggtgtggttgttgcgagggaagccatatagtaagggcgtataacggggatgtgcagcgggaacgttgcgggaaggccgtgtggggcgttgtaagttgcaggacacgggtatgggattcttatgttagttaattagttggttgttttttagttatttgttttgtttaaccagtcatagaaggtgtattgggctcgtacagcgggggtgccgggcgctctttttttgaatatatttcgcaggttgtcgtctacccagcaggctttttggttgtcggcgagctggatattaagcatttcgatgaggctgtcacgcaggtcgggggcgagaatgggggtgatggcttcgatgcggcggtagaggttacgacgcatccagtcgggggagcccatgaagactttgggtttgccgtcgttgccgaagtaccagatacgggcgtgttcgaggaaactgtctacaatacgggtgacacgaatgttacgactgtatgactgtccggggataagacaacagattccacggacgatgaggtctatttgtacgccgtgttcggaggcttcgtagagacggtcgatcatggcggggtcttgaagggcgttcatttttaagatgatacggccttgtttgccttcgtcggcgagggcgatttcccgatcaatcaggcggttcaattcggggatgaggttgaaacgggcgacaagaagggtggtgaacttcgggtcttctttgccttgcagggtgcggaagaggttatagaggtcggccactatcttcggacggcaggtgaaaaggccacagtcggcgtagagggtggcggtcttttcattaaagttaccggtgctgatataggcgtagctgggtattttttcaccgttcagtccgcggcggcggataagggctactttggcgtgtactttcagaccgggtatgctgtatattattttaatgccggcggcttgcatcatttcggccgtggcaaggttgttttcttcgtcgaaacgggctttcagttccacgaatacggtgactttcttgccgttttgggcggcggctatcagggtgttgatgacggcggagttttcagctacgcggtattgggttaccatgatttcacgggtttccgggttgtgcacggcttcatacaggaagtggatgaagtgctcgaaagagtgataagggtaatataataacaggtccttcttggcaacgtagttgaagatagattctttttcgtcgaggatggtcagcttcattggcttcggcttttcgaggctgtgaagagatttgttcgggttgggaagatgacgcaggtcttcaagattcaggtgcttgtcgccggggacaagttcatcacgctgaatatggaaggcgtctaccagaaagtccagaaagtcatgaggcataccacggtcgtagacgaaacggcagacgtcaccgatcttacgtttcttcactttcttcttgagttgagcgacaaggtcggcactgctggcggtgtcgtcaattaatatgtcagcgtcacgggagattttgatgcagtagctggaatcaacatcgtagccggggaaaataaggttgaggtttgccttgattatatcttcggtaaacatcaggtaatggtttttctcgcgggatggaagttcgatgaagcggggcactttggcgtagggttgcttcatcacgaagtaaagaggttgccgggattctgttagactggtagttccttcatttccttctttcttcggatagactcgtatggccaggtaaaggcggttatcccgcaggaaggagactattttatctttggatacaggcacaggctgcaggtagggaaaaatttcttcccggaaaaagtctttaataaactgctggtggaacggttctacatgtctgtcctgataaaagatgatgtgattcttgcgcagggcaggtagtagtttctcttcataaatgcgtacacggtcatccagctggcgggtgacttctttatttatttcttctaccagttcgcgggcggattgtacggtttcttcatcactttccgtagcgccggaggcaacagctttatggtcggctacacggattttgtaaaactcttcgaggttggaagagtagatagagatgaagttgatacgttcgtagagcggtagacgctcgtccagagcctccaacaatacgcggtaattgaatgagagccaactaatatctcgcttgaaataattatatttgctttccatgtgctttaagatttttccaaatatagtatctttgtgggattaaacaaagaaatttatgacaagaattggattattatctgatactcacgcttactgggacgagaaatatctggaatattttgaaccgtgtgacgaaatctggcatgccggagacatcggttcgctggaagtagcggaaaagttagccgccttccgtccattccgggcggtatatggaaatattgacggacaggaaatcagaaagctgtatccgcaaataaaccgtttcacggtggatggtgcagaagtgctgattaaacatatcggcggttatccggggaaatacgatccttccatcatcggcagtctgatggcacgtccgcccaaactttttatcagcggacattctcatatattaaaggtgaaatatgataaaacactggatatgttgcatattaatccgggagctgccggcatgtccggtttccacaaggtacggactttggtacgttttgttatcaaccagggggcctttcaggacttggaagtcatcgaattggcggacaaataaaataaatgttcctgccagattgaaaaattattttaaaattttgccacgtcggaattctttccgacctttgcacgcagttaatgaataactcagacgaacatgaaaggaattattctagccggtggtagtgccacccgactttatccgctctctaaagcgatttccaaacaaatcatgcctgtgtatgacaagccgatgatttattatccgttgtcaacacttatgttggcaggaatacgcgaagtgttgattatttcgactccacgcgacttgccgatgttccgcgacttgttgggaacgggtgaggaactgggtatgtctttctcctataaaattcaggaacaacctaacggactggcacaagctttcgtattgggagccgatttcctgaacggcgaaccgggctgtctgattcttggggataatatgttttacggacagggcttctccgccatgctccgccgggctgccaatatagaaaagggcgcctgcatcttcggttactacgtgaaagacccgcgcgcttatggtgtagtggaatttgacgaacagggaaaagtgatttcactggaagaaaagccggaagtgccgaaaagtaattatgccgttccgggactttatttctacgatgccagtgtgacggaaaaagcagcggctcttcgtccttcagcacgtggagagtatgagataacagacttgaaccgtctgtatctggaagaaggtacattgaaagtggaactcttcggacgcggatttgcatggctcgatacgggtaactgcgacagtctgctggaagcttccaacttcgtggccactattcagaaccgccaaggtttttacgtcagctgtattgaagaaatcgcctggcgtcagggatggattccgacggagcagttgcttctactgggtcaacagctcgaaaaaaccgagtatggaaagtaccttatcgaattggctaaacaatcctaaaatcaacataaagaataaaatatgaaaacttatctagtgaccggtgccgcaggatttatcggggcaaattacatcaagtacatcttagccaaacataacgacatcaaagtcgtgatattggacgctttgacgtatgcaggtaacttaggaacgattgccaaagacatcgacaacgaacgctgtgtctttatcaaaggagacatttgtagccgcgatgtggtagacggtctttttgctgagtatcgttttgactatgtggtgaatttcgctgccgagagccatgtggaccgcagcattgaaaatccgcaactgtttctgattaccaacattctcggaacacagaacttactggattgtgcacgccgtgcatgggtaatggggaaagacgaacaaggatatccgacctggagaaaaggtgtacgctatcatcaggtatctaccgatgaggtgtatggttcattgggagccgaagggtatttcactgaagcaactccgctttgtcctcacagcccatacagtgcttctaagacaagtgcagacatggtggtaatggcttaccacgacacttataaaatgccggtaacgattacccgttgctccaacaactacggtccgtaccacttcccggaaaaattgattccgttgattatcaagaatatcctcgaaggaaagcatctccccgtctacggtgacggtagcaatgtgcgcgactggctttatgtggaagaccactgcaaagcaatcgacctcgttgtgcgtgaaggtcaagacggagaagtgtacaacgttggtggacacaacgagaaaacaaacctcgaaatcgtgaaactgacaatttcgactatccaccgtctgatggcagaaaatcccgaatatcgtcaggttctcaaaaagaaagtgaaagacgaaaacggagatatttcgatcgaatggatcaacgaagatctgattactttcgttaaggaccgtctgggacacgaccaacgttatgctatcgaccccaccaagataacaaatgccttaggatggtatcccgaaactaaattcgaggtaggtatcgtaaagacaatcgaatggtatttagccaaccaagcttgggtggaagaagttaccagcggagattatcagggttactacgaaaagatgtacgggaaatgattctcaatttatcaacattcctattgcaataagaatacccataagcagcatattacgcgaagtctcgcctaatatgctgtttaattttttaccgctgtatattttcaccatccgtttccaggtaaggaaatgagggatcagataaagttgcggaagaaaagcggcgtagaaatgaccttcacgaaggaaacacaagcagagaagagaagcggtaatccccagcatcaaataaaaatagcgaccgaatttctcgccaaaacgaacgatcactgtcctttttccactgcgtgcatccgcttcgcggtcacgataattattgactaccaacaatgtatcgataagcagtccgcagattaaagaggcgatagtgacatccggtgtccaagttagcgcctgtacgtaatatgttccgcctacgggtacaaaaccgaaaaagacaatcaccaatacatcgccccaaccgttgtaagaaagaggataaggaccggtggtataaagaaaggcaaataacacacaaagcactcctacgataatcaattcccacccggcaaagaagagtaacgtacagccgataaggcaggcaagagcaaccgtaataataatcccggttttcatcgcttgcggagaaatccatccttgcgcacaagcacgttcggggcctaaccggtcttcccggtctgttcctttgaggaagtcgaaaaggtcattgatgaaattagcggcaatttgcatcagacttgcaaacagacagcagatcagtgcaggcaaccagtgaaaacgtccgtccattgcagcaagagcagtacctatcataaccggagttatagcccctgtcagcgttttgggacgtgcagctaatatccatgcttgtagtgagttacgctttacttcttccatactttaatatattataaatagttttgacggacaaagatacatgatttttcgtatctttgcaccccgaaaaacttcaaactaagagaagatgaagaaaataaaaacaatctaccctgttatcctgttgacattgcttttgctggtttcctgtaagtcgaaaaagaatatggtggctaccttgccacgccctgttttaaattcagattctatttatccggatacggctaatgccatagccgggttattctcccccgaccactcgcaactcaaagagctgaatgtttccaaaaacaaaaagcagaatacaaagaaaaagacttctaccgatacacacgaatcgtcggatctggtactgcggggaacaaaaatcacttcttccagcgtagatgtatcttctgtctataccggagtggaccgtctagtaaaatatgactttacacaccgcgatgttcccgaagcctttgaaggtttccgtatcgctttcatttccgacttacactacaaaagtctgctgaaagaaaaaggtctgaacgaccttgtccgcctactgattgctcaaaaggctgatgttcttctaatgggtggtgactatcaggaaggttgtgaatatgtggaacctttgttttccgcactggcacgcgtaaaaacaccgatgggaacttatggggtaatgggcaataacgactacgaacgttgccacgacgatattgtgaatacaatgaaacattacggcatgcgtccgttagaacatgaagtagatacgcttcgtaaagacgggcagcagatcattatcgctggagtgcgcaatccttttgatctggggcgcaacggagtatcgcctactctggcactctctcccaaagattttgtcatcttactggttcatactccggattacatcgaagatgtttcagtagctaacaccgaccttgccctggcaggacacacccacggcggacaagtccgtgtattcggagttgccccggcacttaactcacactatggcaatcgtttcatcaccggactggcatataattctgcaaaaatacctttgattataacaaacggaataggaacctccaaattaccaatccgtgtcggcgctccggcggaaatcatcgttattactcttcatcgattaacggagtaaactggatagcctcccaagcctttggatgcacaaagtatcgaacatctttccctgcatccagtgcttctcgaataaaagtagaactgatttcaaatacaggagaatgaacaagacgcaccgtttccggcaattcctcctctttgacgggaaagccgggacgggggtaaataagaatctgattctctttaatgatacgttcggactgataccaatatccaaaacgttcccaattatcggaaccgataatgaaataaaactcgcgatcgggaaatgcctcacgcagtttctccaacgtatatacgctatatgaggggcgaggcaaatgaaactcaaaatctgaagcctgaaaacgaggatagtcactgatgctcaactttaccagttcgagacgtaattcatcattccataacttctcctgtgctttcaaaggattctgcggactcaccataaaccagatttcatccaatccttcatactcacaaaggtagttggctagagcaagatgtccgatgtgaatcggattgaatgatccgctgaagattccggttttctgcttattcattgttccaaaaactctttgataactttcaaagcttccgctttagcagtttccaaattatcattgacaatcacacaatcgaattgcgaagcaaaactcaattcatattccgccttagcgatgcgactttcaatcacttccggcgcatccgttccacgtccttccaaccggcagcgtaattcttccaccgaaggcggctggataaacaccgacaacgcacgatcgccataaaacttcttgatattgcatccgccaaccacatctacgtcaaacaccacattctgacccgcttccaattgcttttctacctgcgctttcagcgttccgtaataacggtccttatacacctcctcatactccagaaattcgttgttctcaatgcgttggcgaaattcttccggcgtaaggaagaaatattcaaccccatgctgctccgttccacgcggaggacggctggtagcagaaatagaaaacgctaaattcaagttctgcgtcagcagataattgattatagtagatttgcccgaacccgacggagcagagaaaataattagcttaccggtcataagtttaatgaagaattaagaattaaaaatgatagatactgttttacatcacgttcagcacctgttccttaatctgttccagttcatccttcatctgaactacgatcttctgcatttcagcatgattggacttgctgcctaacgtattgatctcccgacccatttcctgggcgataaaaccaagcttcttaccctgtccgctaccactttccatcgtgctgatgaaatatttcagatggttgctaagacgttgtttttcctcgttgacatccagtttttcgatgtagtaaatcagttcctgttccagacgattcttgtcgtagtctacgcttaacgtcttttcgagagcatcagtgatgcgttccttcactttctctacacgttctttctcgtaaggagtaatctgttcgagcaaactgttgatgttggcaatcttctcacggaatttcttttccaatgcagccccctcctgtttgcggaaatcgaccaaatgactgatggcttcaagtatggtagcatgcaccatgctccattcctcttccgtcagttcctgaatttccgttttcgtcatcacgtccggcatgcggagtaatagttggagccagtcttccggtgcgggacaaggaatccccagttcgcggcttatcgaatccaactggctataataacttttcagtacatccttattgatgggagcagcatccgcaccctccttcttctctatccacaggctgaagtcagcttttccacgttccagaactttagaaatctcattacggatttcaatctctttttcacgatacgccggagcgatgcgagtggacaaatccattgccttgctgttgagcgacttgatttctacatttatttttttatcaggaagttcggccgtagctttaccgtatcctgtcatagactgtatcataaccttaaagttttgtgcaaaagtacacgaatattttaagaattggaaataatcatgtaaatttgcgacaatttaataagctgatttttatgtcgtgtatactgaatattgaaacctctacctctgtttgctcggtagcggccagtcaagacggacagacgatttttgtgaaagaagacttgaaaggcccttcacacgccgtgtctttaggagtttttgtagatgaagcattgtcgttcatagacagtcatgccatccctttggatgccgttgcagtgagttgcggaccgggttcgtacaccggactccgaatcggggtttctatggcgaaaggaatttgttacgggcgcaatatccccttgatcggtatcccgacgctggaagtattgagtgttccggtgctgttgtatcacgacttgcccgaaaacgctttgctttgtccgatgatcgacgcccgccgcatggaagtatatgcagccgtctatgaccgtcgtctacaagtgaaacgtacagttgccgccgacatcgtagatgagaactcttacctggagttcctgaacgaacaaccggtttatttctttggaaacggagccgacaaatgccgcgaacagatcacgcatccgaacgcacattttatcgacaatatccatccgttggctaaaatgatgttcccactggcagaaaaagtagtggccgatgaagactataaagacgtggcttacttcgaacctttctacctgaaagaattcgttgcctccatgccgaaaaagcttctttaattttttaatttttaattctcaattttaatttaacaaatgcaatacaatactcaacagaaaagaatgccgcttcccgaatacggacgtagcatccagaacatggtagattatgcgttgaccattcaggatcgtgcagaacgtcagcgttgtgccaacaccatcatcaacattatgggaaatatgttcccccatttgcgtgatgtacccgatttcaagcacaagctttgggaccacctggctatcatgtccggttttgagctggatattgactatccgtatgaaatcatccgcaaggacaatctggtgacccgcccggaccatatcccctactccactgcccgtatgcgttaccgtcactacggacatacgctggaagtactgataaaaaaagcgatcgaattccctgaaggaaacgaaaagagaaacctgattgcccttatctgcaaccacatgaaaaaggattacctggcatggaacaaagatacagtggacgacaaaaagattgccgaagacctgtacgaactgtctaacggggaactccaaatgaccgacgatatcgtccggctgatggcagaacgcctgaatcagaactaccgtccgaagacgaactataccaacaatcgtcaaaacaataaaagaagatactaaacactttatacttaatactaaaaaaattaatggcttcatttgtaatcgaaggaggacatcggcttagcggagaaatccacccgcaaggagctaaaaacgaagttttgcagataatctgtgccacgttgctgaccgcagaggaagtgacggtgaacaatatacctgacattcttgatgtcaacaacctgattcagctcttgcgggagatgggagtgacggttgcgaagaaaggcattgattcttatagttttaaagcagaaaatgtagacctggcttatttggaaagcgatgaattcctaaagaaatgttccagtctgcgaggctctgtgatgcttataggtcccatggtggcacgtttcggcaaggcattgatttccaagccgggaggagataaaatcggtcgccgccgtctggacactcactttgtaggtattcagaatttaggggccgacttccgctacgacgaagagcggggtatctacgaaataacggccgacagacttcagggaagctatatgctactggacgaagcatctgtcaccggaacagccaacatcgtcatggcagccgtacttgccaaaggtacgaccaccatttacaatgccgcctgcgaaccctacgtgcaacaactctgccggttactcaaccggatgggagccaaaatcagcggtatcgcatccaacctgctcaccatcgaaggcgtggaagaactgcacggcacgcaacacaccgtactgcccgacatgattgaagtgggcagcttcatcggcatggcggcaatgacgaaaagcgaaattaccatcaagaatgtttcttacgaaaatcttggaatcatccccgagagcttccgccgtctgggcatcaagctcgaacaaagaggagacgatatttacgttcccgcacaggaaacataccagatagaatcatttatcgacggctccatcatgacgatagccgacgccacttggccgggactgactcccgacttgctaagtgtgatgctcgttgtagccacacaagccaaaggcagcgtactgatccatcagaaaatgttcgaaagccgcctgttctttgtggacaagctgatcgacatgggtgcacagatcattctctgcgaccctcaccgcgccgtagtcatcggacacaaccacggcttcaagctgcgcggcgcccgcctgacttcaccggatatacgtgccggtatcgcccttctgattgccgccatgagcgccgaaggcaccagtaccattagtaacatcgaacagatagaccgtggttatcagaacatcgaaggacgtctgaacgctatcggagccagaatcacccggatatgataaagaaagaagaagtatacaagataggattattcaataaaccgcacggcatccacggcgaattgcaatttaccttcacggacgatattttcgaccgtgtggactgtgattacctgatatgcctgctcgatggcattttcgtgcctttcttcatcgaagaataccgcttccgttcagactccaccgccttggtgaaactggaaggagtcgacagtgccgaacgtgcccgaatgttcaccaacattgaagtctacttccccgtgaaacacgccgaagaagcggaagacggcgaactgtcctggaacttcttcatcggtttccaaatggaagacatccatcacggacttctgggagaagtcatagatgtagataccactacggtaaacacccttttcgtggttgaaggagcggaagaagaggaactgctcgttcccgcccaggaggaatttatcgtaggaatagaccagaaacagaaactcatcacggtggaacttcccgaagggttgctcaatctggaggaattggaagatgaccggtgagaacgaatcaaacgatgagccgctcatccactgaaaatagtaaatagtaaatcgtaaaaacagtaaatacccgagatgccaaagagaagacgaagtaaagctttctggaaaaatttcaagttcaagtataaactaacgatcgttaatgaaaatacacttgaagaaattgtcggacttcgcgtatccaagctcaatggactttccgtattactttgcgtgctggcggtacttttcctgatcgcttcctgcatcatcaccttcaccccgctgcgcaactacctccccggatacatgaacagtgaagtccgtacacaaatcgtggacaatgccctgcgtgtagactctttacaacaagtgctcaacaagcagaatctttacatcatgaacattcaggatatcttcagtggaaaagtatccatcgacagcgtgcagacactcgattcactgaccactgcccgcgaagacacactgatggaacgtaccaaacgggaagaagaattccgccgtcagtatgaagagaatgaaaaatataacctgacctccatcacttcccaaccggacgtgaccggactcattttataccgtccgacacgaggtatggtgtccgaccacttcaatgccgagaagaaacattacggcaccgacatcgccgccaatcccaacgaaagtgtattggcaaccatggacgggaccgtcatcctaagtacatacaccgccgagacaggttatctgattggcgtacaacataaccaggatttaatttcaatctataaacactgcggctccctcctgaaaaaggaaggtgaacgcgtgaaaggaggcgaagccatcgctctggtaggaaacagcggcacacttagtacagggccgcacctccatttcgaactttggtataaaggtcatccggtgaatcccgaaaaatacatcgtattttaagtgataatagaaaaatgaatatagagactaacaaaaagaaaaaacaaatagctatcctaggctcaacaggctccatcgggacgcaggctctgcaagtcatcgaagaacatcccgacctgtacgaagcctatgcgctgacagccaacaaccgcgtggaactactgattgcccaggcacggaagttccagccggaagtggtagtgatagccaacgaagaaaagtattccgaactgaaagaagcattgagcgacctgcctatcaaagtgtacgcaggcacagacgctatctgtcagattgtagaagcaggccccatcgacatggtgttgacagccatggtcggttatgccggactaaaaccaaccatcaacgccatccgcgccaagaaagcgattgcgttggccaataaagaaacattggtagtagcgggcgaactgattaatcagttggcacaacaatatcgcactccgattctgccggtagactctgaacactctgctgtttttcagtgtttagcgggagaagtgggtaacccgatcgagaaagtgatattgacagcctccggaggtccgttccgcacttgcaccttggaacagctgaaatccgtcacaaagacgcaagccttgaaacatcccaactgggaaatgggagcaaaaatcacaatcgactccgcttccatgatgaataaaggttttgaggtgatcgaagccaaatggttgtttggtgttcagcccagccagatcgaagtggtggtgcatccgcaatcagtcatccactcgatggtgcagtttgaagacggagctgtcaaggcacaacttgggatgccagatatgcgcctgcccatccagtacgcattctcctaccccgaccgtatcagctcttctttcgacaggctcgatttctcccaatgcacgaatctgacgtttgagcaacccgatacgaaacggttccgcaacctggcactcgcctacgaagcgatgtaccgcggagggaatatgccctgtatcgtcaatgctgccaatgaagtagtggtagcctctttcctgaaagacggcatcagcttcctcggcatgagcgacgtaatagagaaaacaatggaacgggttgccttcatcgccaatccgacatacgacgattatgtagctacggatgcggaagcaaggaaaatagcagccagtctgatatgatccgcttcatcccattgatgaacaaagaaaataaagaaattgattagtattaatataaattgaaaatagcctttatatcctctcttcggtagagaattagttgaaggctttaaactgtaaatagactatatggaaacatttttgattcgtgccctgcaattgattatgagcttatccttgctcgttatcgttcatgaaggcgggcattttctttttgcccgtttgtttaaggtgcgtgtagaaaaattctgcttattttttgacccttggttcaccctttttaagttcaaacccaagaaaagtgacacagagtatgcagtaggctggttgccattgggcggttatgtcaaaatagccggcatgattgatgagtcgatggataccgaacagatgaaacaacccgaacaaccgtgggagttccgttccaagccggcgtggcaacgtctgctgataatggtgggtggcgtactgttcaacttcctgttggcactgttcatctactccatgattctttttgcatggggcgaccaatatataaaggtacaggaagcccctcttggtatggaattcaacgagactgccaaagcggtaggtttccaggacggtgatatcctcctttctgccgacggtgttcctttcgaacgttatgacggcgacatgttgagccagattgccgatgcacgcgaagtaagcgtcatccgtaacggggcaaaagcctccgtctatatcccggaagacctgatgcaacgcctcttggcagacagtgtccgcttcgcctcctaccgtttcccgtacgttatagacagcgtaatggtgaactctcctgccgcacaagcaggaatccaggcaggtgacagcatcatcgccctgaacggaacaccgatctctttctccgacttcaaagaagcgatggcagaacgtaagaaaaacgaagcaaccctgctcaaagacagcatagatccgcgtctaatcacgctgacttatgtgcgtaacggtgcaacagacacgctaagtatgcgtgtagactccgcctacctgatgggtgtaaccgcctgtctcgtcacagaccgtctgctccctatggtaaaaaaagaatatgccttctttgaatccttccccgcaggtgtctccctcggtgtgaaaaccctgaaaggctatgtaggaaacatgaaatacctcttctcaaaagaaggagccaaacaactgggcggcttcggaacgatcggcagcatcttccccgctacctgggactggcaccagttctggtatatgacagccttcctttccatcatcctggctttcatgaacatcctccctatccccgcattagacggtggccacgtgctcttcctcttctacgagatgatagcccgccgcaaaccgagcgacaagtttatggaatacgcccagatgaccggtatgattctgctcttcggtctgttgatatgggctaacttcaatgatattttgcgattcttcttctagcgaatataacaatagaaagatagagaaaacatataaaaagaatcatcccggatgaaaaaggttttaaaaaccaattttcatccgggatctttttttattgttgtttgtctttaaatcttcaacatcttcttctctctccaaatccgtctcatccaacttaggtgaaggcaccgtgcacgttttgatataatctccctcctgacacgtataattatagtacacctccaattccggagtcaattccgcccgcggaaccagacacccttccatctccagaaactgattaacatccgtactatccgactgtttcaccagtacaatacgacgcgcaatcggattatgattgtagtccagacagagataaagccctttcagcatattcggaaactcataatgcggaagttgcaggtaaatagtcaccagcgcaaactgtggcaaatccctttcgttgaacatcaggtaagagttctgatgattactgataatcccgctcccccaatgcaccgacttatacgcattaatcatccccaccttcacatactcattattctcggaagcacaaatcatgtacggctcgatcttcaagctatccgtagaagacgacaaactgtaactaagatacataccgctataattatacacctcctgcacagactccttcgcctctttccccagcaacttgataaaagagttgccattctccgcctcgctctgcacgtccggttccatctcctgaagcaacagcctcaccgatcccacattatttaataagcgtttcttggaaacattattcaccagtgccaaagcttcatccagcgcctcgtccggtgtgcgtgttttcaataagtcgatataagcgggaagcacactcgaatacaaagcagacaacacactcggagccatatccacccggtcggcaatttctttcatcttcaccccgttgttgcgcaggtactctattcttttataaatatccgtaagttcgtccatgatttttcggtttgttaattgattccgttgcaaaggaatgactaaggtattatgtttgtattgcatgaatattacattaatatttcagtacacttaaaggctcatatatacaatatgattcattgaaattcattttttcgttcgctccgacaccctacttttgcaccggaaacaaaaaaaatagcattatgaatttcaaagaaaaactgtcgccttcggcccaaaagaaactttccgatttactctttatcctttatgcgggaggagcggcactgctatcctattcattagtctacgcactacgcaaaccgttcaccgccgccacgttcgacggcatggaactatttggtatggactataagatagccaccagcatcatccagatattcggatatatggtatccaagtttatcgggatcaaacttatttccgaactgaagagagaaggccgcctgaaattcattcttgtttctattttagtggccgaactctctttggttcttttcggatgcctaccccgcccgttcaatgtgttggcgttgttcttcaacggactgtcgcttggctgtatgtggggagtcatcttcagcttcctcgaaggacgccgggtgacggatctgctcgcttcccttttcggacttagtatcgcagtcagtagcggcacagccaaatccatcggacttttcgttgtcgacaccctgcatgtcagtgaattctggatgcctgcactgatcggtgcggtagcattgcccttgctggcaggactgggctatatcctcgatcacctgcccaaaccgactgccgaagacaaagcactgcgtgtggaacgtgtcactctcaacaaacaacaacgctggaacctgttccgcagctttgctcccatattgacactgcttttcttcgccaacctctttctcaccgttttgcaagatgtcaaggaagactttctggtgaaaatcatagacgtcaatgccgccggactttccccgtgggtattcgccaaagtggacggtgtagtcacactgattatcctggccattttcgccaccctggcagtgatgaaaagccacatcaaagtactttccgttctattgacccttgtcattgcgggagcaatcacacttagcactgtggcattcaactaccataccctgcaactttctccgctcgtgtggttatttatccagagcctctgcctctatttttcttacttgagctttcaaaccatcttcttcgaccgcttcatcgcctgtttccgcatcaagggaaatgtaggtttcttcatagcgatggtcgattccatcggctacacaggcacagtggtggtattggtagtgaaagaatgtttcaacccggatttaaattggctggaattctacaatacgatggcagggacagtaggaatcgtctgcacctttgcgttcaccttagcaatgatttatctgacacaaaaatacagaaaagggaaacagggtgaaatacgcgggaacgaatcttgccccgtcccctccctcgcttcttactaatttctgacgaataaaccaatattatatagaaacaagaatgaaaaagattgaatgtattattatggactgggctggtacagccgttgactatggatgttttgcccccgtggctgcttttatcgaagcatttgccgaaaaaggactggtaatcgatgttgtacagacccgcaaaccaatgggactacccaaaattcaacacatccgcgaactactttccatgcctgacgtgaacgaacagtttaccgcccgttaccaacgcgcctggacggaagaagacgtggtagaactaaaccgccttttcgagaagcatctcttcgcctctctcgaaaactacacagaccctattccgggagtaatcccaactttggaaaaattgcgtgccgcaggtattaaaataggatcgaccaccggctatacccgcgaaatgatggatgtagttctccccgccgcacaggcaaaaggataccacgtggattattgcgccactcccaacctacttcccgccggacgtcccgctccttacatgatttttgagaacctgacgaaattagcagtccccagcctcgacgccgttataaaagtgggtgatacgattgccgatattctcgaaggagtgaacgcgaaagtgtatagtgtaggcgtgattctcggcagcaatgaaatggcacttaccgaagcagaaacaaaatcaatgcctgcctccgaactcgaagcccgcatcgccgatgtcaaagagcgcatgcttgccgcaggagcttcttacgtgatacgcactatcgaagaacttcccgcactgattgaaacgatcaacgccggcaactaacattcaagcccgcacccaacaatcagaaaagaaacaaaatcatttatttattcatttctaaagaaaacatcattatgaaaccatatttgttattaactccgggacctctaaccacctctgaaacagtaaaagaagccatgatgaccgactggtgtacatgggacgaagactacaacctcggcattgttcaggaactccgcaaagacctggttaacatcgccactaaaaaaccggaagaatacacttccatccttttacagggaagcggaacctattgcgtggaggccgttttaggcgccaccatcaccccgaaagacaaactcctgatttgtagcaacggagcctatggcgaccgtatgggcaacattgcagaatattaccatctcgactacgacatgctggcttttgaagaaacagagcaggtatcagttgaatatgtagacgattatcttagcaataactccgatatcacacatgtcgctttcgttcattgcgaaacaacgaccggtatcctgaatccgatcaaagaactgtcccacatcgtcaagatgcatggtaaaaagctgattgtagactgtatgagcagcttcggaggtatccccttagatgtaaacgaactcggtatcgacttcctaatcagcagttccaacaagtgtattcagggtgtaccgggattcggattcatcatcgcccgccgttcggaattaaaatattgcaaaggagtggcacgctctctttccctggacatctacgaccaatgggaaacaatggaaaaaggacacggaaaatggcgcttcacttcaccgacacacgttgtccgtgctttcaaacaagccctgaccgaattgattgaagaaggaggcgtagaagcacgttaccaacgttattgcgaaaatcaccgtattttggtggaaggaatgcgtgcactcggattcaaaacactgctcgaagatgacatccagtcgcctatcatcacttctttcctttatccgcatgaaggattcgacttcaaaacattctattatgcactgaaaaataaaggattcgtgatttacccgggaaagatttcaaaagcagataccttccgtatcggaaacatcggtgatgtgcatccggaagacttccgccgtctggtagaagtcatacgggaaacgaaatactagaaagtcaaatctttcaagttcatcttgaatgattacttactgatatgttgtatgatgttcctgtgaagttctgaaagacttaatcctctttcaggacttcattattttcttttcagggtggaaggctgtgatagcctcaagctactgacgatagctgccacaacggcaaacccactccccaccatcaggcaaacagccgtgctccggctatgagtgacaaagctgaaaagcaaggcaaccaatgttgttccggtggtctgtcccaacaggcgggccattcccagcatcccactggcccctcccgaacgctgcgtaggagcggaagagataattgtactgttgtttggcgtctgaaacaatccgaagcctgcaccgcataacatcaaacgcaggataatacttatatcagatgattcggcagtcagactggaaagcgagaaaagcccgatggcaaacaaaaccatcccgatacttcccagtataccggggtgaatacgctccacgagataccctgccaatggagccgtgaccagcgtagccaacggccacggagtaagcaaaagtccggtcatcacctcactgtgtcctaaagtgttctgcaggaaaaaaggcagggaaaccattgccgacatttgagcgataaaggaacaaatggaagtcaggatggataaccggaaaatcggaatccgcaacaggtcgagcggcaatagcggagtagtctgcgtgagttgccggcgcacatagtacgtgcctaccactgccaatacaaccagttggatgaaaaggaaatccatttcctcgtgatgggcgaatccgtccagcgtatatataagcaggccgaaggtaaccgcattcgctatggcgctgatataatcaaacttgcgtttcgagcgttcctcctgccttggcagatgtttgatgccgaggaacaatgcggtaagtcctaacggaacattaatagcaaataaccagtgccagctggcaatagaaagaataccgctcgccacagaaggcccggcggcagccgatatggcaacgaccatcgcattaatccccattccccgcccaatctggctcttcggatagatgtaacgtagctgtgccgtattcacgctggtgatggcagaggcactgaacccctgaaaaatacgggcgacggttagcgtccaaaacgaatcggacaaggcacagatcaacgaagtgatgcaaaacaggccgatacccgaaagaaagactttccggtaaccgatgatttcacccaaagcggaaaaagacagtagcgatatgacgatggccagctgatagccgttgataatccaggtggttacagcgggagaagtcccaaaatcatgcgaaagcgtgggtagtacgatattgacgatgttaatatccaataccgacatacaaagagcgaatccaacggacaccaccgcccaaatacgcttaggcatcggcaatccgtcggtttcctctattttttgagttgaatttatcgattgtaccataaaaacttattcttgtaagtagtcattcttttttcaccataaagcaacgcagggatgcaaacacaaacaccaccgacgacaaaaaaagcaccgcgttactctgtgatgaaaaatgattcacttggtttcgtaaaggtaaacaaaacaatggtacaggtgtttttgtttcctttgaaaaataagtttttttagtggagaaaagtcgttacttcaacttcaagatccgttgattactgcttcccctgaactccagatacggagagaaaagagcctgctcgaagcgtccgtccaccaacacatctatataatcaagggcagcactcaagcggggctgtgccttgatttcttcgtagctatatcctgtatagcaccacacattcatccccgtctcctctttcacccgtttcagtaaaagcagaaactcctccggatggaagaacggatcaccaccggaaaaagtaacaccgtccagcaaaggatttgccttgatttcacggatgatggactgtattttttcttccgtcaactcttcccccgccctcggattccagctctccgggttgtggcaaccaggacagtgatgggaacatccggcaagataaatagagtaccggatgccttcaccatcgacaatcgtttcaggataagttcctaataaattcacttctacaggtgttttacgcggtcttgttcttctgcccgtttagcagagttccaggaactcaaatcgcctgtcaggtaaccggttatacggcgcatacgaaggatgctttcactctggcacaccggacatttatcgaagataacccctttgtaaccacagttatgacaagtatctaccgggtgattgatagagccgtagccaatcccctcgtcgtgcatcactttcacaatcttggcgatggcacgtacattcttctgtgcttcaccgtccagttctacatacgtgatatgtccgccgcgcgtaatggcgtggaacggagcttcacgcttgattttctcaacgatgctgatcggttctttcacgtctacgtgaaaagagttgacataatagtcgcggtctgtcactccggggatttttccatatttccgacgatccattttagtgaaacgtcccgaaagtccttcggcaggagtagccagaacggagtagttcaggttatatttctctttatattcgtttaccactttattcatttccatcaccgcttcatacagcgtgtcccatgctttctggttgtggccgtgaccttgtccgtagagagccaccatcgcgttgtgtccgccgataaatccgatacccagcgtaccgctgcgcaatgcatcacccacctgttcattcgggttcagctcaccgccgcctttccacacattatttcccatcataaacgggaactgacgtgccagggccgtacgctgatactgataacgctcgtaaagctgatcggctacaagcacggacatttggtgtacggattcgatgaaaatttcttttgccttctgttcaatggcatccttgttgcgttcatcctctatcaggttttccgccttgatgcgggcttcaatcgccagtctcggcatattcagcgtagtgaatgaaagattgccacgacctaaagaagatttttctcctgccacgttttcaaagacacgggtgcgacaacccatcgtcgccaattcgtagatgtaacgtttcggatcgtccgctctccatttctcgttctggttgaaaggtgcgtcgaggaacatgaagttcgggaacaatgctttcgccgtagtctggcaagccttcaacagcaagtcgaagttgggagcctcgtaacggtcggtcattgcctcttcgatattttccgctttcattgctttctcaaagtctttttccgagtaagaaactccgtctttcaccttgaaaatctggatcgggaatacaggcacctcacctcttgtacccaatccttcaatggtagctttcagcaattcttcgatcaccatgcggccttcggcagaagtgtccgtaccgtagttgatggagctgaataccacctgattaccgccacgtgaatgcatcgtgttcaggttgtggataaatccttccatggcctgatgggtatctttgcgagtctgctgataagctttctcaacgatacgggcaaggtgttccttatctataataatctgtaaagccaccaaagcaatgcgcaatgtttcgcgttcggcttcagtagtcttgatagacggaagatattctttaatcaatgtgcggatggatttctcatcggcctgatttccgttttccatggcgacatagaaattgatgaacgatgccagatgcttgcggaaagatttggccacaccttttgccatgaagaaatcgaaagcaggaattgcctgtccgccatgctgctcattctgattcgtctggaaaataatagtagccaacgtagcataactctggatgctttgcggggtacggatactaccgttcttggtgcgaaaaccacgttcaaagaggtcatccatatcatattggatacaggtcgtcgtctttgtcggataataatccaagtcgtgaatgtgaatatctcccaactggtgcgcttcggcaaaacgtttcggcaacaggtatttatacgtataatctttggttacttcggaagcgaacgtcatcatctgtccggcaggcgtgtgactgctcatgttggcattgctcaagttgacatcgttcttgtcgatagcaacgatgccgtccatcacttgcttcatctgggttttcttatcgcgctccgtattccgccattcgcgataaataatatatttcttcgctacttccgggcgtactttcatcaacgacttttctactaaatcctgaatctcttctacggtaatagtaggagtagtaaactgactgattacgttcatagtgatgtcagccaccaactgctgctcatcctgaatacctgttgcactgaatgctttactaattgcattcttgatcttactgatagagaaatcttctctcttaccatcacgtttgatgatacaaatttccgcgtagttcataactttaactcccgaaagtttaaatttaaaatattgataactaaaagaaaaagttccggcaggtcttctgacttatccctccctcgcaacaccttcccacaccgacatcgatgcagtggcttattgtgcggattcttagagaattacagcagcgggtactgtcgccgatttacacagcgttccctcattgactaaacctcttttagctccgaaaccggatacaaagatagaagataatctaatagcttggttagcttttaacattaaatttcgggaaacatttctttctcgctgatacagaaagttttccaaaacggaaaacttttttctgattttaacgtggataatattccaattccgtttatttcacccaaaagacatatatagtttttagctacttcactcttagcgaaaaaagaatgtgttaaaagtctccacaactatcttttgcttcataagttacagactatttttcactttcgaccaaacctttctttccgataaaatgaaagaaattataatttttcgatttcttctttcgaaagcccggtagattttatgataatatcgtcagccactcctaattctttcaaattacgagctgtttcttctttacctttttgcaagcctttctgcacccccttctgttcagcaaagtccaacgtattaaaataatcgttataaactttccattcttcttcataccgggctctttcctcctgggtcatatttgctttggaagccaacttttcaagtcgctcgaagacggccttgcgagccttgaaaggcatccggtcaagtgtatccatatgctttagtatataaatccagcgttcaaaatcattttcacattcatcctcctctttgttgaagttcggcagttcgataaaaatctgccggaacttgttgctgaagagcttccccgtatccctgtcagaaagaacgatatccgttctgattttagagggcatatccttgtccatcacgaaattcatgaagaacactccgtacacggcatccaattgaaagttccaaactccccttttcgcctgctgcgtaatggccctagaaagatagaagagggcacgatctttaaagtaaggctgttcccggttctgcatttctacgataatacgttcaccggtatcggttacgcaatagatgtcgtagataagacctcgttctgtttttacttccggctgctgttcactgttaaggaactgaatgtcggtaatcacatgctctcctacgagcaaatcgttcaagaagtcgattaacaactccttttctacctctctgccgaataaaaacttaaagccaaaatcggtaaagggattgataaatcttcccattatatgctgtgtctcaattacaaaacaaagatagagtttttttgttgaatacggtcaagaatagaaaaaaataaatgggtacaaaaaaagaagctgcctcattcatcgggagacagcttcttcatttgaaccttgagccttactttactttcactttatgagttgctccacgtttgttaccggttccgtgagctatgtgcgggcggcacgtttcgttttttttcaggatcatttttttacacgtacactaatctttttccgtcttactgcttctccgatgacggaaccgcagaacagcctcaagaatgtctaacaacttttccagtaataatttcattcgcttttctattaaggttgataatctattttatatcggtcgaagtgcaaccatcagctatacccgattcgcggctactgataagtctatcaataagctttagtttgcctgacaaacttatcagttaatccctacggattcagctgccagctgcacttccggtcaagcggccgggtccggcgcttctcctcctccgccaccgggttcgtcgccgtcatccgggtctttgtcaacgacatcgtcggccacaaacgaacccgctacatccttgatgtgcacaaactccactccggtggtcaatgcgcgggtagcacttccgttagcggcacgggtgtattcaggggtaaactgacaacgcaatgaagtgatctgcgaactgctgactttactctccaactccactccttttcctcctgctttggcaatcattgtaaatgttcccaagccttcgagacgcaccgtgcggctgttgagcaactgttcgcgcatcaccgacatcaggttacgaatcacgttatgaacatcacccgccgtcagcgaggctttttctgcaatcaattccgccattttctgcgtattgaccattttcccgaatttcaccagacggggataataaagtttctgtccttccttgttggcaagtgttgcctgataaggtttgtaaattaatggcatactgttttcctttcttttttgattgatgaataaataactactgtttgtaaccgattacgaagacaaaagtacacgaagagaaaaaagcagggaaacacgatgttacaacccgtcgcaagagagaacagacaagcacaaattgacacgattcatgcctgcaaaggcttctgtacaacacagaaccaaccagcataaaaaggcgtacctttgcatgagttcataaataaacctctaaaaaacagtcaatatgaaaacagaaacaaccccaaaagcagaaacagagagccgtacccgcatacaagcctatagcaaaagccagttggccggactttacctacctcacatacagtccgcctcggcacgacgcaccctccgtagttggattgccaagaacactgcactgcaagccgcactcgctcaaaccggatatagtgaaaaagccatcctgctcactccggcacaagtaaggctgttcttcaagtttttaggagagccctgaaacgactcttttacaagggaaatatcattcggagaaagacaaagccaaacaaggcaagaaaaaaggcaagccaaagcaaagcggacatttcatcacagatcacgcgaatcaaattataacttgctgattgctgttataaagagtccaagataatctgtaacgaactgtccgctcattatataaaaaaaggattatatcattccggagtacctcctcccgacggcttcatcaaatcggctgtaacctccgctttaaaacggacaccgtcgtgaagccgcagattcaatttgacagtaacattctcatcgttgttacgcttcacataaaacgttcccgtcacccttttatattgggaataataatagaacggatcttcgtaaataaagaaatactggtcgttttggtacaaggtcgatgcatccaccacttgcccctcccaatacatacccagagaaaacaaaaaataagtactagttttcccgtcctgtatcttttccggagaaaagatacaagtaaaataaccaccgtctatagtagcctcaccggacacgatcctgttcgcttccccccggaatgaataagtaccgatggaaggcaattcctccacatccggaccgggatttaccggatcattatctttatcgtcactacatccggcaaaacccaccagaagcaatcccgataaaacatataaatttaaatatttcaataagattttcttcatgaatacacttcattaaatcgtcactctattactgtcaccgcacctttatagtagccggacaaactggcatcgccatatttcttaatacctaccacttcaaaagtcatttcaacttcattgccctgaagagacaccgaagtccggcctcccagagccagattgcccaatgtggtattagcccgactgtaagtcactccttcatacgtaatcgagattttcacattttcatcatcaccggagaatccgcggagcactccatccagcattgttttcgaaagacgcaccactgcatccgctgccgacattcccgccacagtagtgatacctggctgtcgtgaaaggtaaataacacaaatatccgcatccgtcttatctatcaccacagactggatagtgaccggagtaccgtccgcccctaagcgatattcattcgggatcgtcgtatcatacaccacgaaagcaccgttatagttacctgatattttaaggctattatcacccaaatatttgaggttaagcgtcaatgaatattcattatccgctgatttcgatacactgaacgtacctgccgcatcctccaggtgacctttggatatttgtattctttcttcgtcatacgggctataataagtaaattcaaaagccagattggtatttgttatatccacttcctgcccgttaagtcctgcgttcgggacaaagagacgcacataatatgtgtttacattctccaagtccgcagcagacgaaattctcgacggagtgagatacaatgccactccttcatccgtcttttcatagaaagtagctttgatgtcacgcgtgttttctccgttcaacgttaatatattcgtcgtactctgtttaatttcagaataagcaccctcgtaagaaccttcgaactttccacccgaaagcaaagtaaagctgaaagttattttcacccgattatccgtcttttccactttgaacttacctgccgaacatatttcagaccatccataaggatctaccgcagtcaggtcgtcagctcccaattctgtcatattatagaaagcataatccataccgtcataagacgtgatatccaatacctgtcccaacatagcgggattgattccgatcatcaggaactccgtatccgacatatcttccaccgttgtcagtcctgcgtacggactaagataaaaatattgaattcccccgatgacagtagccaccaccgatttcaacggacgcacttcacttccgaaagaaaattcactgggcaactttgcaggagccttgtagctacaaccagcctcccctgtaaacttaccgccacttttcagcgtacaatcaaaagtagctttcacagccgatatctcattctcacccggagtcatcgtcaaagtgatcttgccttgcgtcagcacctcttcccattcgtaagggtccacggctacaatagcctcaccatcggcatccatgtaataaagcacataatcgtcaccttcagagctgcctaccgtaaccggactgcccaccagactcttatccactcccagcatcacatattcctttccgctattcataaagtcttcaagcgtttccaaactctgcaacggactcatacacacatacacaatgccatcctgttcaaaacaagacaccgatttagcttgtatcgtcttatccttatacgtatacgtattcactgtttccacaggttccagttccggctccggttcgggatcagtggccggatcatcgtcactacatgccacaaaacaactcattgccaacatgaataagaaaaaggaaataaatctagttttcatatttctcgttttttgggttaattataaaatcgcgttattagtaaaatgatgccatccacccgtgtttactgcggacgataatcaaatacggtaataggagcatcctgcgaataagtggtacgtacatgattcgggtgttccttatcacagtcaataaaatctatcgtcagcgtgtgtttgtcaccgtcgcgtgccacagtcatggttccgccgtctatgcgtgcatattctttcatggctccgttctgaagtttctcataccaggttcctcccggataagtaaagccgttaggatagcccgaagctatgtttcccggtttcagcaactcgcgcgggataccatatgattccttatcacgcgccaccaccgtataagtacctgccggaataccctgtgttacatccgtagcccattccacgaaaaattccaccttcaatactcttccattaccggccggccaagtgtcgacaagacttatactctcttccgccagataaagctcgactacccggcacgactcatcttgcagataataagaatcgcccttatcctgcaggcgggcttgcgtccatccattcagtgcaatatcggtggtcagcgtagaattaggagtttcatccttgctttcgtgacggtcgatggtgattacttttcccgtataggtgaaataacgtttcaaggaaagatcgcccaccaatgttccgctaatcgaatattcaccaccggacagccgtttcaccgtcattttaccaccggaaagcaaatcggcatcgacactcgtagagtaagatttcacatcaccgtagaaagttccggcaggaatatccacctttccggtcgggagatcgatttgattcatatatccgaggttgaatgtccattcatcaaacgtgtatccgttcaatgctgcatcaaaagtgccttcagggagcggaaattccgtagcttccgaagcaaatggcgggacattcaggctgaacgccatgatcttgcccggtcctatcggattaccagtagcatctacttccatatccgtataaagcgtcaatacaaaatgatctgtgcccactccgtctttatctccccagtacaccaggttggagttgacaaactccaccacttccggcgccgggtttacgtcttctccaccgggttttcctccctccggattttcggcgtcattgtcactgcaagcggtcaacacccccacagacgcaacagcgaacaggcagacacccaataacttcattattttcttatccatatcagactgatttatatattttacatcattgaaaagaacttccgtagcgaccgggaatcataaaaaaggcggagtaagctcgggaaaaggattcccattcttcgcacgagtatccccgcctgtcatatagtaaagttaaattaagagagaattagtaaattctcattccgtttcacaacggtagttcttttctttattcatcaatgttatgttcgttttatctgaaaagtgcaatatccgggaaaaggatacaatctttcagtgtcccggtcaggaactgctgtccgtcaaacaatgctatcgccaggtagcatccgctttccggtgctccggtcacgtcctgaaaactgactccgacagaaccgtcctgataaagcacaggagcgaaaccgaaatttcctttcgaataaatattggaagaagccgctacagaaaagccgtacagggtttgcaaaacaacacctgccccatcatccgatgttccgtccgatactccacctgacgttccgtccgaagcgccttctgccacctcatccgcaacttcttccacgaccgtaaagtctttctgtgccgcaccgataggaaccacaaacgatccattttcataggtagcctgcaatgaaatcgtagcctttgcggggtctttcagatattgcgctgccggagtatttgccaacgacatcttaatggtatatccctcgccatcgacattcttcgaaatttcagtagccgacaagggataggcgttttcgatattcttcgtatcccatttcacataaatccggctatttccccacactccaagcaggtccgtcgcttcatactggtagacgtagtaaaagaacttccgcccttcattggtgctgaccaacaactggcaggcacggggattaccggttttgttctctttcaacacaagcaagaaaccatcttcttttgaagcagccggcacctccacccagtcgattccccgctgcacgctcactttgaaatcaaacgaactattcacccgtacaatcgtctgtgaaggagcatttccgaggcgtatcacctgctggtcggagtcgggagcaaaaatatttccctcctgcgtcactacaattttctgttcgctattgccatcgctcacggtcacctgcgtggcacgtgacgtatattcataattggctctgacaagcaaagttatcttttcgtttgtcacttcgattaccctgcaccagtccgcacccgaaacggcagttagttctccggtagcctgcaaagccacttccactgttccgcctccggctaccagatcgacgtccgccttcatgacgcgaaagccttgtgccgtttcatcgttttccttgtcgcacgctgtcatcagcaaacagcacgcagataataacagtataactaacttattcatcatatcattcttctattgtttttttaatcaacctgattgctgcaactgcatccgtgtatcccatgaaagaggcctcctcatcctgcgagtcgtacacaccgaagataaatccggagatttcacccatccacactccattgtccaccagataaatgccgtcggtggtaggataactgataagaccgattgccgaactgcgcaaaacataatcattcatcaaatcccacatagccagatatacgtaacctccctgtactttcttcaagaattgcggcaggatggaaagtccgccacgcggcttgtcgtaagttaccagaatgtcatattcgagtcctttaagccagtagctcttgccgtcctcgttcttcaccagttgaatctcctgcgaagccacttccagttggttcgtcgcaccgttcaggcggtagaaatccatcaaataagtgcccggataatagtcgtagctctgatatccgtcaatgtagatgcctttcatcttcactcctgtagctccttcgtcggtacagacaaagctgatttcctcgttcttccagacaaaattctgcatggtttgtccgtctatcgtcaccggttcgtgaaaacgcattccgtcggtggtaaacataaaaggtacggttttctgatacacctttccaacttcgtcataataggtcacaatgaacgtatagttgctgcgtagcatttgcccggtgtagagtccgtccatccgcaggtcgtattcataaaagaaagcatcgtcttccactttctttatccgggtgagatattgcttccacgtctggtcggcagaaaaagccttcatcacgatgcggttgccatatttcttgcctttcagttcgatacggtcggcggtggcatcggagatcacaaattcgtagtcgcctccgagcgttccgttcgggtcgtcggccatacttccctgcggttgcccgaaataatgcaccaggtaattgtaggtatcgaaagacaacatcgtcgcctgctcggacttgacgctataaagcgaactgaccgtctcatccgctcccgctatctgcgaagccatcgtcacccgctggccgtcgaacttgcaaagcagggtaatacctcccagcgagtagtccttaccgacgtaatattccatcacccatccgttgggtgctgcttccagcagttcgctgcaacgcttcacatcggccgtggcacggttggcagacgaatcgtcaaaataatcttcttcctgaaagaggcacgactgcaaacccaggcagacaagggccaacaggaaatatatcgttctatttttcttcatcataataatgtgtaattaaataatcatccaatcgtcaatcaaaaaaacaagaggtgaccggcacttattgaatagtgctcaagtcaatttcggtaatctcctgctggcggcgcagcacgattttacgaagttcgttgaggtcgatcccccatgtgtcgcgcatatagttatagacaatcgtgaatttcttgttgatgatggcagcgcccgattctccggctgccgtcatcatattgtcccagtaggcctgcgtatgcgtgacgtacatggctatattttccacaaaatcctcgttggactggctcatggcataagccgtcacgaaaccgtcggaccaggccacatcgtccgtgcggggcatggcaccctgggcggtcatgtagtaataccagtcggctcccacgtattttccttccgagatgcggttgaaagaagggtcgaaattccgtttctgatgcaggatatgggcaaattcatgatgcatcgtttcaaaataatactcgttgagcttttcgatattgatcttctttatgttgaggtcgttcacgttgtagagggtgattttcttcccgccttctgccgtgccgagcaccatgttaccgctactttcgtaggcgggcgatccgatgaggtggaatgtcttgggtacgtagacacggagaaaatccattcctgccagttcgacgtaagcgtccatccagacgtgtttgatgattttcgacagtgccaccgctttgtcatagtcggcgggcacgaggttgtatttatgatcgctctcgatatccttcatgcggtacatgaagtcgatgttatacggataggtgtagttgtcgagcagccagtagtcgaaagcatttctctccagcggttcggtagagaagatgctgttcgcggtgtctatctcgtcgttattgttgcaagcccccaggcagactgtggtgagagcaagcaaagagtaaatgatctgtttcttcataattttcacttttttctctgttagtttcttctcgggttaggttgcattcccgccacgatcacgtttcgcggaatctggatggcacggcgcaggtcgttcggcggcatttcgtcggtgacacgttgagtagccatgttgcgacggtaaatcataataccataccgtttgatatcgggccagcgcatcccctcgtgcagggtagtgacacggcgtatatgcagaatacagtgaagaatattttcctgcatcccttcctcgatagtgaaatcgggagcaagctgtttcttgggcgtctgttgcgtgaaaggcgtgtagaaattcattttatcataatacgcattgatctggtcgggtgtcagggccgatttattgcgggtgtaggcacgttgccagctcgtgatgtcggcagccgactgggagtacattttcttcaacgcgtatgcttcggcacggcaaagcagggtttcgtccgttgagaacaataccggcatataataaaggtagccgccatcataaagtccgctcttgcgcaggatgctggctacaaatccggtggtagagaaaggtttcagatacaaataatccgagctgccccacagtcctgcagaaagacaggtttcgctggtggcgagcgtttggttgtggaagtaacgcgggcctaccaggtagtcgcttccgagtgcgccccagttggagacggtgctgcttatcagcaggttggcctcattggaagaagcaatatacgcatctgcctgcacatttccgttcacggaaagattgctcaatgcttcccagtcgcggagcaggtcgtcggggttgctgcccaacacacgggtggcaaagtcaatcacccggtcgcagttggagaaatcgggtttcatataataaaggtagaaacgggcggcaaaggcataggcggccttgcgggtgaaatggtatttggggacggaatatccgtcgtccgaaatcagttccactccctccaggaggtcacgctccactttccggtacacttcttccagcgtgccgcgctcgtaacggggagacacggtggtttccacgtcttccatataggggattcccaacgattcggaggcatgagtgtcataagcattgcagaagatagttgccagcatgaaatggcagtaggcacggcacaccagtgcttcaccgcgctgcgggttgagcgatgccggatttcctttctcctctatcgccttgagtgccatgttggcggctgaaattgcaccgtaataacctccccaaagggaattgggtgtgtcctgatattcctctttggtatcttcccagttgtaacattccttttcggaaagctggtagtaaccgtaggtggggccgctatcatcggagttgtcgctgtagagttcgaacagttcgttgggcgatacgtcgggataggccgatacaagcagtttggctattttctggtcggtgttcagttccgtgcggttgtccggtgttttgtccagaaaatcattgcaggaaacggtagtcagaccggaagctgcggtgagcagcagcacagggagtatatggtttattttcgtcttcatctatcgtatattttttcgggttctctattgggggttacaatcacagtcccagacgcagggtgagggtaaactgacgcggaacgggggatgccacccctccggtgttcacaaattcggggtcctgcccgttcaacttcttgtcggcgtagatcaggaagaggttggtagcctgcaacttgagcgacaggttggatattttggcaggagcgatccagcttctcgggaactcatacatcagtgatatttctttcatgcggataaaatcgcctttggcgatgcgctccgtagaatagttgtaggcgttgtaggcaagataaagcgatgtattcgtcctatattgcgggtcgctaagtatcaccgggatattcgttctcgcttcgtcgccggaaacagtccagcggtttttgaattcacgcggcatggcggtaaggtcggaatatttgtagttgaacaccgggttgaggcggactacgttgccgaaagagtaagtcataaagacatttagtttgaagcctttataggtgaatacattaccgaaacttcccgtgacggtgggatcggtaggaccttcgtatttcaggtaatccagtttttcgcgttcctggaagttgatgctggtgctagtcacttttccgtcgatgaggtattgcggaataccgtcttcatcaagtcccgcaaaagggatggagaagagtccgcgcacggggtatccttcgcgggcaaagccgttgccggaaacgagttccatcatacttgtgagtcctttcagctgggtgacttcgttcttggcataggagaagataaagtctgtgttccatgaaaaatcattcgtgcggatgttgcgggtggagagcgtaaattccacaccgtgagatttcatggtggctacgttggcatatttgttgatgacgccgcctactccctgtgtggggactacaccgatcaggtcgtagttgttacgctggtaccagtcggcggagaagttgatgcgattttcgagcaggccgaggtcgatgccgatgttcagctcatgctttttctcgtaagtgagttcgctgttctcgatgtcatcgatataaagtcccgtttcctgaatgtcggtaaaggggcggtagggcgagaagctgcggatgatggcttgcgagttggtcacttccgccgggccgcggtcggcggtgagggagtatgaggctttcagtgtcaggttggaaagggtgggttgcagcgctttgaagaaagattcttcatgcacgttccaggcaccggacaggttccatgtgggtagccagcgggatgaacggctgcgtcccatgcggttggttccttcatagcggaaagtgccgttgagggtgtagcgtccgtcgtaagaatacgtggcgttgaagaagctggctatactccgggtttcggagtgtcccaggctgtaatagcgcgaaccggattcgataccgttcttgaagaactggtagatgtaggacggaatttcccccatcgaatattgcattccccagccttggaaagaggaatatgttttttgaaggctgttcacttccattccggcaaagaagttggtgatgtgcttttcggcgaaaagatgattccatgagagtgttccacggaaatcgagtcccagcatacggcggtcctgacgctggtagataccgccttcgggcagcagggtaataggcagggcgtatgggttgtcggggtcggtatagagcagtttgttttgctcgcggatggtggcgtcgtccataccggtgcggtaggcgattgcctgattggcgtcgtcgagcacgttgtgttcctgcgatgaagtctggtatctaacggctccgagggcactcaattcgagtccctgaatcactttccacttcatctcgccttgaaatttcacatcgaccatattgatttcgatgtagttattgtcgagttcgtggagaatattgaatggggcgtagttgctgatatagtccacagaggggtcgagtgtgcggcttgtgttgagcgcgtatgaataagggttgatgtcgaatccgcgggacatctttcctgatgcgatgtcgagggtggagttcatcgttcccggcgcgttctgctggcggtaggaggcgttggatatgaggttgagcgacagatttttatatatattataggttgtgttcacattggccgtatagcgtttcaccttgctctgcttgtaccaaccaggatcgagcatggcactcaaggaggcgtagaaagaggatttttccgttccggcggtgatgctgacggaatggttctgcgaaacggcattggtgaaaagcacgtcgaaccagtcagtgttgcgcatttccgcttcgcggaggtaagcgttacgggcttcggtggtgttgagcagtccgcgttggccgttactgttgttgtattcgtcgatgaggcggtacatacgaccgtacactccggtgtctctggtgcggaaaaggtcggcactgttcaaccagcctttctgttccatttctttgtagattcccatctgttcctgcgaattcatgatattgaattctttgtagctggggatagcacgggtggtgaactcgcccgtataactgatcttgctgactccggcacgtcctttcttagtggtgactacgataacgcctgccatcgcacgtgcaccgtaaatggaggttgccgaaccgtctttcaaaatttggaaactctcgatatcgtcggaattcagtccggctatggcggaactaatcagtgtctcggcatcaccggaggaaagatcatcgggacctacgtcgatggcgtcttccagaatcacgccgtcaacaacccacaacggtttggaacttccgtaaatggaagtggctccacgcacacgaatcttgggggcagttccaaaagtgcccgaaacattctgaacggaaactcctgccgcacgaccttccagtccgcgactaatgtcgggcaaaccgtccagcttcacattatcggcatttaattgtttggtggctccggtaaaaagacgtttatccattttctgcataccggtcactaccacttcctgtaatacttcggaatcggatttcatcattaccttgatggtcccggacttgatgggaacatcctgcgacttcatgccgacataggtgatttgcaaagttcttgatgaactcatgcattttctgcccctccttccataagtgcttgagcacaaaatatttaataaatataaaaaagaaaataccgaaaggggaataagaaaagcaaaaaaggaagtgaaacgcaaaataaatcgtccttttttgctttttatctacttactgaaaaggtagaaaatatctttcatgtagcaaacctcaagtccggcagcaactctcgtctccccaattagggtattaatataagagactacggatagaatttctttctttgtccaataaactatcttttttctacctgcaattatttatttgcagattattatgtgttattaaacatcttatctacgaatttatccacatttatttatcaaaaagatacttattttcgtttattaatcaccaaaaagaaacaagaaaccgcctttcatgtacttatcttgtatttaagtccttttgctacaagtattttgtatcgacagcacaaattcatattttttttcatatttttctttgtttttctaaaaaagtggttacttttgcgaatcgtaagattctactatataaaaactatatgaaaagaaaactaacgctgttattaacctgcctgctagcaggcattagcctggcaatcgctcaaacctccagaaaggtaatgggcgttgtcttctccgaggaagacaaccagcccgtcataggagcatccgttttagttaaaggtacatcaataggaaccaccaccgacctcgatggaaagttcgttatcaataatgtaccaagttcatcaagaacttggtaactcccctcccgctttcttctattttccatcttttttcttcacctttccttccttttcaccagtctccaggaacagtgttttatcgtcatgaaactgaatatctatacgaatatgatgactatcatcaactgtatagcctacatccgcagaatctcctagaaaaagcttcagaatccagcacaacacctccggaatattgacaataatcgttgcctttccaatcacacaagagaaaaaattaaagatagttgtccaatttggtataggactccgaccgtcgaaattacacctgtacacacgccccacggacgaacgcgaacaatccgaattcttttcaacatatttttctggaatattattcagttgccccaacttaaaaacacaatcaattactttcttcttaacatcatcgtcgctgtgacgtacaccggtcatttctttctgaccattttcactgttaaaaaccacttctctttctaccttagtcattttttacattttatttaatatttacatataaaattcacgacaaaagtacaatgcttattttaacatatatgttcaagcatgacacattctatatttttcatccatattttcacaaagaaagagggtttggggtacccattttctaccttaccggtattatcaagaaaatagatgaaataaaatctgccaaagaggaaagaaatcactcgttccaaaagctgtgatttgcgctaaaaaagagaaagcattcctgcactaaaagtttcaacgtttcattatggttcaagcttggacagcctttgcattacctgctctctacctttgtccccataatcaaatcattaaaacgaatcaaaatgactgaaactgaaaaaaatcattccttccaacgggtacagctaatgaagcaagctgccgtcatccggcaaaacaacggtatgaaccggcacgatgcactcgtcacggctcaccggataggggctctcatccggcagatgcatcacggaaatgtctgtttccgctacaccaaacaggatggaaccatccgacacgccaccggcaccctcaccggatatgaacatagtttccaccgtccgtatctacccaaaccggaaaatacgttcgttgtctactatgatatcgaagccaaaggctggcgcacctttcacgctgaaaattttctggatatcgaaacggacgggcaagacagcaacaagtaaaaatgaatctgcaaaagaacggaatgaacgggcaggaacgaaaagaatgggaggcgctttgcagacagtataacgtagattcgctatacgaggccattcaaggctgccgggaagaactggagtttctgattcattgtgccgaacggctcgaacctcatacggaggaggaggaagaaacgccgtttaacacatacagaccacagcgtttctccgcaccagaaagcgccgtttaacagatggaggaaacgccgtttctccccgcatgattcagaaaaacgattattttttaacagagtataattttattaacattatcaatatcaagtatggaaaattggagatttattgaagaaaaccccgactatatgatttcagatcacggacgggtattgagtttcaagggcagatcaaagttgatcctttgtgccaaaatcatggggaccggttacgaaactgtcatactgccgaataaaggtgtttgtatcgaatacaaaattcatcgtttggttgccaaagcattcatccccaacccggagcagctgccacagattaaccacctcgatggcaatacgatgaacaaccacgtgtcaaacctcgaatggtgcgatgcatacaccaatatgatgcacgccatccggacgggattacgacgtacgggagtgggatctcatcaaacacctttcgccgttacggatgcaacggggaaagtattgcgtgcctacccgtctatgaaagaaatggtcagagaggaacgtctgaagcctgcgcaccgaaactggcttatcctccaactaaagcatccggaccgcgtgaaacaacacgccttgcgtgtgcaacatcatcggggagatgcttttattatggttcagacaaggcctaaccagaccacagtgcttaatcggacgacaatacctaatcggcccaccatgcctaatcaaacgacaacgccgccgatggatgctcccttctctccggtgctccattcagtaacaaagcaatattaccgccaactgtccaaagaggaggctattgcgttcggggttatctcacgtgccgtctgcaaacaggaaaggaggattcttccatgaaagacacgatcatcatccactgttccgccactcgtgcgggacaggattttaccgctaccgacatcgaccgctggcatcgtcaacgtggttttcgttctatcggttatcatttcgtcatccgtctcgacggtacgatagaaccgggaagagatgttgctctcgacggagcgcattgtacaggttggaaccatcggtctatcggcatctgctacattggcggattggacaggaacggccggcctgctgacacacggacggaagcgcaacgtgaagcgctcgtccggctggtagaagatttgcgccttgtcttcccttctctgaagcaggtgatagggcatcgggacaccagtcctgacctcaatggagacggcattatctcacctgacgagtatataaaatcctgcccctgcttcgatgtaaaagcagaatttattcagtaataatcaaccatttacaaccagcattttatcatcatggcccgcatttccaaacccggattagattatttccccctcgatgtcaattttctgcaggacagaaaagtacgccgcatctcctgtcgccaccacgcggcagggattgccgcactcacttcgctgctctgcctcatctataaagaaaaaggttattatattttgtggaacaaagacactcttttcgacatcgcccaggaagcgtgttgcggggaggaggaaatgcaggccatcattgatgattgcctgtcagtggggctgttcgatgatcttatatataaggagtatggcgtactgacttcacaagcgattcaggaacaatatcataaaatcatcaccgacagtcggagaaaatataaattacctctggaacatttctggattatcaaggaggagagtagtgaaatagaaccggaaaatacggatgactccagtgccaactccggcaaagatgttacaaaaccccatgaatttgctacaacaatgccacaaacaaaagaagaaacggatacagatatcaaaggtaaacaggaaaggaatatggaaaatgaaatcaaatctgaaataaaaaaagacatagagacagagagggaaagaaaagacggaaaggagaatgagaggagcatgccgcccgttccgtcaaacagcgtttttcaggcttcgcctgtcgttgtagagggtttgtctttggataaatcgattggaaaagaaacggtttcggaagggatgcaagcgggaggaggctcggaagctatacttctacttaatatgcaaactatcggcatccggaacgaacagaccgtaaaagcgattgtcgcccttgcccgacgtaaagaattgggaggccccggcggtattttatggaaaattcttagttcccaataccgccctaccctactcaaaaagaatgaaccgggtgattacattctttgggcactcaatcatccgacggaatttgaaaacacctacaacgggacactgaaaaaactaatcaggggaagataaagcggaaaagtctgcctataaacaaggaacctttttatttttactgcaaaagggatggaaaaccaagaattatcgtacctttgtagtacgaagaaaaagcctcttttttatgtataaagagaaacgtctctttgcaaaacataaaaagaagcgacccaaaacaatgagtaaatttatcaatccgttcaccgactacggattcaaactaatattcggcagagaagtgtctaaggatttactaatcgaatttctgaacgacctgctcgaaggtgaacgagtgataacggacttacagtttttgaataatgagcaattgccgctctatccggaaggacgaggtattatctatgatgtatattgcaccacggacacaggcgaaaaaatcatcgttgaaatgcagaaccgtatgcaaagcaacttcaaagaacgctcgatttattatttatcgcgtgccatcgtcaatcaaggaagggtaggcaatgaatggaagtttgaaataaaagccgtatacggagttttcttgatgaatttcattatcgacaagaacataaaactccgcacggatgttattctaagtgacagggaaacaggagaactcttctcggataagttccgggaaatctttatcgctctccctctcttcaacaaaaacgaagaggaatgcgaaacgaattttgaacgttggatttatatattaaataatatggaaactttaaaacgcatgccgttcaaggcacgaaaagctgtcttcgaaaaattggaagatatcgctgatgtggcttctatgtctccggaagacagggagcgatacgacaatagcgtcaaagtgtaccgagattatttggtgacaatggatgcagctgaacaaaaaggtgcacaagaaacccagctgaaaatagcccggaacatgaaagacaaagggatagacaatgagtctatcgcagaatgtaccgatttacctttaagcataatcgaagggttataaagtaatcggattcataaaggcactatgttgtaaccaaccgtttacgaacgaagaaaataaaaagaggtgagctccctttgcagggtagtccacctctttctcttcatacacaaacattcaaattatcaggtttcaggtgttcgtcaatataacggataccgtccatcttaaaaagcccccgcagaagcgtatagttcaacatacgctgcaccaggtacggggtgccttgcaagctgctctggtagatgacctcctgcaaatccggtgcaaaacggtcgggatcgactccgggaagcagataaccgcaaatcttacaatgcgtcaagacatcaatcaactgctgcaaccagaaagcctcctcccgctcgaaagcagcacggtattccctgtcggtagcaatatccatcagcaacttcttccccagcgaatgaagcagggtgagatagccatccactgtgatgaaaagtgcctccatgcacgagctgtccatccgtatctgtttttgctggatctggcttctgattccgttagcaaaatcagaaagacagacacggaacagactcgttttgctgggaaagagcttgtagagtgtccgcttcgacatcttcattcccctggctatatcatccatcgtcaacccgtcggcaccatgctggtacatttcccgcttggtgtagtcgagtatccggcaacgcagtgtttctggattcatacatacctccctacatacggccgccacccaatgcctgatacaaagtgattacgccctggatttcagtaaagcggttcgccacttgtgacagttgcgcgttgagcaacgtctgttgggcggtcaatacttccagataagtggtgttgccatgtttcatcaacaggcttgtgcttttggctgctgtttgcagggaagccacctgcttgttgtagtagtcggctttctcgcgggcagtctggtactgcaccagtgcctcgttcacttccacgcctgcgttcagcaaggtctgttcgaaactaaggcgggcttcctcctgttgggctttcgctattttcagttgggcgatgttcgctcctttattaaacaaaggctgcgtcagggaagccacggcggaggccaggaacttacccgggttgacaatcatgctccctgcactgttggtccaccctgcgctgccgctcaacgtgatggcaggatagaaagcggcacgtgcggcattcgttgtatagaaagcctgtgccaacgaaaattctgcgctacgcacgtcaggacggttggcaagcatctgtaagggaacacccacggagaagttttccggcaactgttgatttcccaatttgccacgctgtattttgtgaggagtttctgccagtaaaagtgccagtgaattttccgcctgattgatttgctctttcaggtcgagtacggtggtacatatattgaagtaggtagcctccgtctgcgccagtccggcctcattcaccatcccggcctttttcatggcacgggtggcatttacactttctttccaggcagcttcggtagccacagctatctcatactgcgaatcgagcatcagcaaggtgtaatacgtattggcaacggatgctactaactgcgtcttgacagcctgttcatattccttgctctgttcgtaggcagctttcgcacggcgtttcgctgttgtcacctttccaaaaatatccagttcccacgaagcagtcacgggcagcgaataagtttgtgtagcctttccacggtcgaagctgctgacagctccttccggtgccagaaacaaagaaggcagataagacagtttggacgtcaacagcgtggcttccgcttctttcacacgcaaatgggcagtctgcatatcggtgttgcgcaagagtgccgaatccaccaaattctgcaaataagggtcggtaaagacctcccgccacgagaggttaccgaagtttgccgtatcggtggcagcaacagactcgctgccgtaaagtccttcgggaacttccgataccggtttgtatttattgtagataccacaactactcaatataagcgttgctgcggacagaatgattatttttctcattagttcttattttaattcaggtctaaaacctttaatcatcaattattcttttccagctttagatttttcttcctcgctcactttgatttcttcttcaatctgccagtcatgcgtcgggacgctctgcacgggacgcaaacgttcctgcaaccactggaaagcaataaacaaagtaggcacgatgaagagcaacgccaacgtaccgatggtcataccacctactacacccgtacccaatgaacggttaccgttggctcccactccacttgacatcatcaacgggaacagaccgaaaatcatcgtcaatgccgtcatcagaatcggacgcagacgggctttagccgcactgaccgcagaagcaatcagccccatacctgctttacgacgttcggcagcatattccgtcagcaaaatagccgtcttcgccagcagaccaatcaacataatcaaacctgtttgcagataaatattattctccagtccgaacatccaggcgaaaaggaagctacccatcaatccgcaaggcacactcaaaagaacagcgaacggaataatgaagctctcataaagcgcactcaaaataaggtaaatcatcaggaagcagataccgaaaataatgatcgtcgtaccgctctgctggttttcctcacgggtgatacctccgtaatcatagccatagcctttcggaagagactgttcggcagtttcctgcacagccttgatggcgtctcccgtactatatccgtcggccggcatcgcatttaccgcaatggagttatacatattgaaacggctcaacgattccgcaccgtagctacgggtcagcgtaacgaactggctcaacggcgccatctctccattcgacatacgcacaaaagcattatcgagggaagtttcgtccaaacggaacaccggatcggcctgaatcatgacacggtacactttagagaaacggttgaaattggacacatactgtccaccgtaataaccggacagcgtactcaatacagcgtcgggcgtgatacctgcacgcttacatttagctgcatccacctctaccgtccactgcggatagcgaacgtcgaacgtcgaataagccatcgatatttcaggccgctggttcaaagctcccaagtattgctgggtggtggtgaagaactcgttcatatcaccgcccatcttatcctgcatgtggagttcgagcgcattacccataccgtaacccggaatcatacccggggagatggcgaacacactggcatccttgatatcagccgtacgcgcatatacctgaccgatcaccgactgcacattgtcctcatcacccgaacgttcgtcccacggtttcagtttgagaatcaacataccgaacgaactaccctgtcctgccaacaatccgtaaccggccactttctgcacgtgtttcagttgaggtatttctatcaggcgtttttcgatacgttccatcaccttatccgtcgttgtcagcgaactgcctgccgccgtacttacattcacgaaaataacaccctgatcttcgtcgggtaccagactggtcttcgtgttattcatcagtaacacaagcaataccacggaacaagccagcaacgaccatgtcaaccatctgcgcttgataaagaacaatacaatcgtcttatatttatccaccatcacatcgaaagccgaattgaaagccttacggaaacgtgccgcaaagttgttcttctgcgttccgtcttcattaatataaggtttcagcagcaatgcacacaaagccggactcaaagtcaacgcgttaatagcggagatacctaccgcaaccgccatcgtcaaaccgaactgggtatagaacgtaccggaagtgccgcccatgaaggacaccggaatgaacaccgccataaataccagcgaagaggtgataacggcattactgatacctttcatagcgtcgatacttgccatatatgacgacctgtagcccacatcgaaccgcgcctgcaccgcctcgacgacaataatggcatcatccaccaccgtaccgataacgagcactagcgcaaacagggtcagcaggttgatactgaatccggctatcgccatgaaagcaaacgtacccaccagggaaaccacaattccgaccagcggaatcaatgtagaacggaagtcctgcaagaagacgtacaccacaaggataaccaggatgatagcctcgatcaacgttttcaccacctcatgaatggaagcgaacaggaagtcgttggagctcatcatctgcgtcagttccacgcctttcggaaggtctttgcttgcctcttcgaggagtttgtcgatattctggtttacttcggtcgcattggaacctgccgtctggaacaccatacaggatacacccggatgaccgtccataccaccgtggtaagcgtagctgtcctgtcccagttggatatcggcaacgtctttcagtttcaagacttcgccattgtcggtggaacggatgacgatatccccgaattcttcgggagtaatgagacgtccggtgtacttcatcgtatactgataagtctcatcggaattttcaccgaacgaaccggtagccgattcgatattctgctcggcaagcacaccggtgatatcggacggaatcagtttgtactgtgccatcacgtccggtttcatccatacacgcatactatattcaccgcccataatcatcaggtcgcccacaccggagatacgaagaatctgcggtttcaggttgatgctgatatagttggacaggaagttctcgtcgtaactgtcgtccggactatacaatgagaacatctgcagaatactcgtctgacgcttggaagtggtcacaccgacctgggttacctccgccggaagttgtcccgtagcacgtgatacacggttctgcacgttgacagccgccatatcggggtctgtgccctgcttaaaatagacggtgatgctcaccgaaccggaattggtggcggaggaagtcatgtaggtcatgtcttccactccgttgatcgcctcttccaaaggcgcaataacactcttctgcaatgtttccgcactggcgccataataggtggtactcaccataatggtaggcggagcaatatcgggatactgctcaacgggcaagctgaacagcccgatgatacccactacgacaatcgtgatagagatgactgccgataatacggggcgttctataaaggttcttaaattcatgaatgattcctccttggtttaattttcagtagtagttgccggagacttcgttgttgtctctgttgatgaggattgattagcatttgtcactcctgccactggagtttgagcagcctttgccttgaccggagtaccttcacgaagcaaacctactccttctgccacgatcacatctcccggtgccaatccttcatctacaataaattcccgaccgccattgacacgggtcacttgtacctggctggattgagccttgccgtccactaccttatagacatatctcttatcttgtatttcgaaagtggcagcctgtggaatggtcagcgcagctgttttttgaacaggaacaatcacattacccgcaccaccgctatgcagcaatccttccttgttcgggaaaactgcacgcaggctgaccgtacccgtcgaacggtcgatcactccgctgatagattcaatctgtccccgttcggagtaggctgacttatcgttcagttgcaggtcgatggcaggcatatttttcaatgcttcctctttagaaccgtattggcggatcagtcccagtaattggttttccgtcatggagaagtagacgtacatatccgaattgtcggaaacggtagtcaacggctgggcaagagcggaactaaccaaagctcctacacggtaaggcaacgtgcctaccactccgtcggccggacttttcacaaccgtataagaaagattattgcgggcactcacttcctgcgccttggcctgtgccaactgtgctttggcagccaacagggagttttttgccgtactcaaatcgaaagaggaaatcacgttctctttatacagttcctctttactgtcatacgtcagttgcgctgtagccagagaggctttggccgattcaacgtttgccactgccgtctgcaaagcagcttcatacggcacttggtcgatgataaacaatgtctgtccgttctttacacgctgcccttccgttacacagactttagtcagcgtaccacttacctgggggtaaatatcaatatcctgacgtccgcggatggtcgccgagtaggcgcttgaaatcatccggtcggccggagaaacggtcatcacttcgtattctgtttccatttgtgccggaggagcttgtttacagcccgtagcagctaccatacagcagagcaacaatagcccttgcttcactttacatacctttttactcattttctgttacctatttaactatttttgaacgcggcaaaggtagactgttttcttcataggaaactggacttagtatcttcagttttgttcattttaggaacattaaaaccgatatttagtgaaaaagtcctatttttgtacccaaaataagaacaacaatggaatcaaaaaactctagcctagccatacttcatgaaccgttcgttgccggaatggacgaaaacctgtctccaattatgcaacgcctgtggaaactggaagggggtgccatctatttttgcagaagcggatgggcacacgtcacaatcgacctgaaagactatgaaatagtagaaaacactcaaatcgtgctcttgccgggaacgattatccgcatcaatggcaacagcagcgatttcacagcttctttcttcggatttcccaaagaaatgtttcgcgaagcctgcctccgtttcgagccgatcttcttccggttcatcaaagaaaaaccgtgctatacactcaaggatgaaagcacaggagcaatcaacgggttaatgcgtgccacaacagctatatacaacgatcgtgaaaaccgtttccgcaaccagatcgccaaaaatcatctccagtcgtttatgctggatatttatgataagtgttaccgctacttcgaccgacaggaaatcgaaggaggaagccggcaggatgaaatctttaagaatttcatcgcactggtacatgaaaactgtatctcacaacgggaagtgactttctacgccagcaaactgtgtatctccaccaaatacctgacaggtatctgcaaaagcgtgacgggcgaggctgccaaaaagattatcgacgactttgccatcctggagataaaagtgttgcttcaatccaccggactgacgattcaggaaatagccgaccgacttggttttcccgatcagtcgtatttaggaaggtacttcaaacggcacgaggggatgtcgccgaaagagtatcagagtaagtattctatctaatcaagtaaaataatcttttattattagattattaggcacggattacgcggttcttttattaactaaaaccgtgtaatccgtgcctccatttattttattaatttgtatttatcgcacaacacagattgttaacagatctgtaatactatcttaatctgccttgcattcctttgcaccgtgaaacaaaaacacgggtgtgaataactttattgcatttaataaattaaaagaagcaaggtaaaagattatgaaaagaaacaaatggctgctttctctgtcaattgggctcttgtgctgtggctctgcatacgcacagacaacagtgaaaggaaaaataacgagtgaaggtggggaaccgttaatcggggctaccgtagctgtgaaaaactcgacagacggcacggtgaccgacatcgacggaaactactccctgaagactaagaaaacattgactcaaaaggatttgcttgtattcagttatgtgggatataaaacgctacagaagaactatgcaggcaatacgatgaacgtaaaactggcggaagagtcgcaacaactgaatgatgtggtggtgactgccctggggatcaaacgtgaagaaaaaggattgggatatgccacggaaaccgtgaaaggggatatgattacgagtgccctgcccaccaactggtcgacggcactgaacggcaaggtagccggattgagtgttatctcttccggtggtccgcttaattcgagccgtatctcgctgcggggggacgtctcgctgaaccagaacggaaacgacgcattggtggtagtggacggtgtaccgatgagtagtccgatgaccaatccgggtgttgcctacggtgcaggttcaaacagcgaactttccgtggactatggtaacggattctccgacatcaatccggatgatatcgaaagcatccaagtattaaaaggggccagtgcgacagccttgtacggtacgcgtgcagccaatggcgtgattatggtgactaccaaatcgggagcgggtgcacccaaaggtatcggtgtgtcttacagcggtaacttcagtattgacgatgtgatgagatggcccgattaccagtatgaattcggacagggattgccgagcaatatcggtccggcaggttctatctacgaaggccagccctattactcttacgggaaagcggaagacggcagttacgcaagcactagcggaaccagtagcgcttacggaacacgtttcgacgccaacaggttgttctaccaatatgaccccgtaacgcagggacgcgcttctgttgccaccccttgggtagcgtacaaaaacaaccgcaaagatttgttccagacaggatacaccctgaccaactcggtagccttgaccggaaaatccgaccggggcagcgtacgggcgtccatcacccacactaagaacgaatggattctccccaatacaggtttccagcgtatcaccgccatggtttccgcccaacagcagatttcgagggcactgcgcattaatttcaagtcgagttatacgtaccgcaagctcaacaacacgcctgcactgggatataacagtaactctatctcctacttccttatcttccagaatccgaatgtcaacctcgactggttgcgtccgatgtggcgtaccggacaggaaaatgtgaaacagctccaaccgtacagttcctttatcggaaacccgtatgtcattctgtacgaatctgaaaatccttcggagaaacacagtaatgtatcatccatttctgccaatctgcgcatcaacagtaaattcgatttcatgatccggtccggtatccagttgtcagccgaccaacgcgaacagcatcgtcctatcagtgacgtggttttcggaaacgggtttttcaagaagcagaatgtgttcgattatgaattaaacagcgatgctttatttacttaccatgattcattcgccaacggattgcgtgtcaacgcttcggcaggtggaaacatgatgcaacaaagctacgatatgttggctgcctcggtggtaggattgattacgccgggagtatacaaactggcaaacggtgtttccaacccgaacgtgcagacggttatcaaaaagaaagcgctgaacagtctttatttcacggccaatttctcgtataaggataaactgtttctcgatgtcaccgggcgcaatgactggtcgtctaccctgccgaaaagcaaccgttctttcttctatccgtcggtcagcgtcagtgcagtgatgaacgagtggttcacgttgccggaacagatcagtctgttgaaagtgagaggttcgctggcacaggtcggcaacgacacagacccttacaagacatcgccctattatggcacaagcgatttccccggatcggccattgtatcttctacgctctataatcaggatttcaaaccggagatttcgaccaattacgaaacgggattcgacttccgtatgtttcacaaccgcatcggactcgatttcacattctattataaccgcaccaaaaaccagattctggatgctccgatggacccgaccacaggttacagcaaagctaccatcaattcgggatgcgtccgcaaccgcggttacgaaatccagttggacgttactccggtagtcagcagggatttccgatggaatgctactttcacctggtctaagaacgagaaccggattctctcactggcggaaggggcggatgagaaccagttaatcagcagtatcggtagtgtgtctatcatcggacgtgtgggtggaactacgggcgatctctggggatataaactggtacgcgacccggaaggaaatgtggtcatcaacgacaacggattgcccgaacgttcgggagagatcgaatacgtcggcacggcctatccgaaatggaaagccggactgtataacgaattttcttataagaacttcacgcttagcgtcctgctcgacggacaggtgggaggtaaaatgtactcgcactcgcaccacaaaatgacggaacagggaaaactgcaacataccctgaacggacgtctgccgggaacggaattttatatgtcgaaagacgatccgcgcatcgctgccgccggactttcaccacaagacgggatgtacatgattgctccgggaacagtgaagaacgatgacggaacttactcgccaaacaccaaagtggtgaccgtggaaagttattataaggaatattaccggatggccaatgtggaaactaacacgttcgacacttcattcctcaagttgcgcgaaatgagactggagtacaaattgccgaacagcacactgaagaaaacaccgttcagcaaagcatcggtggcactctacgcacgcaacctgttctgtatcaccgactatcctctgttcgaccccgaatctgccgccctcaacggaagttcgatggtgaccggtgtggagacgggctcactgcctacggcacgtactttcggactgaatattaacgtatctttttaaacactgacttatgaaaaccaataaacttttcaaaaatatagtatggggaatgactttgtgcggagctctctgcacgacttcctgcaccagcttcgacgaactcaatacagaccccacccgcatggatgaggtgaatcccggcacgctgctcaacccgattttatacgaaacatcggtctacaactggaaacgctacaacagctatacctacgacctgatgcaatgcgccgtatctaccagcagcaccaacggtgtgggatggtggtatatgacggacagcgaaggagacggcacatggactacttattataaatggatcaacaacgccaaagagatgatgcgcctcaccggaaaattgccggaagcctccaaacaacccaactacgatgctatatcgctgactttgcaatgttggctataccagattctgacggatgccttcggtgatattccgatgagcgaagcctgctccgccgacgagggaatacttgcaccgaagttcgacacccagcagcaggtgtaccaacagattatcgacaacctgaaaacagctaacgagttgttcgacaaagctaacgggttgatctacaaccaatcgggcgaaatgttgtacaagacgtccaaaggggatgcaaccggtattttgaaatggaagaagttctgcaactcgctccgtctgcgtgcactgctccgggtgatcgacgtgccggaattcaacgcgaaacaggagctgcgtaccatgctgaccgatcccgccacttatccggtattcgaatcgaacgatgatgctgccctgcttgccatcagcggaacttatccggaggaagctccgctcacccgtccacaggatttcacttcttatgttcagatttcagagttctttgttaatctgctgaaaggttggaacgatccccgtctgcagatgtatgcaacacaggtcactctccccgaccagactaaagattatgtgggtttgcccagcggttatcagacgttgccttcaatcactgcttcgggactgaatcaggaaatggcgaaggcacctatgaaacttgccatgatgccttatgccgaagtggaattcatcaaagcggaattactgaaaaaaggagtgatcgacggaggaagtagcgctgccaaagaggcttatcagaagggagtgcaggcggctatcgaacagtggggacagaaaatgcctgaccattattttgaaaatccggaagctgcttatgatgatacgctggaacgaatcatgaaccagaagtttgtcgcactgttcttctgcgattatcagcagtggtttgaatataaccgtaccggttttcctgtgttacctgtggggcccggcatcgcaaatgctaataacaaaatgccgaaacgctttaaatatccatctgctctgcagcgtactaatctgaagaattatcaggcggctaaagcgaacatgggaggcgatgacttccatatccgactgatgtggcagcaataaatgaatgtgtcggtcaccaagattgcggcaataattatcatttcaatcaatctttaaaattcaatgaatatgaaaagaataatcagtatggctgttgtgttagttataacgatggcagcaatggcgcaaaaaggagagctcgccatgaacgagaatatttccggaaaagaccatatttccaaaaacgaaaaagaagctactcccgtaggcaaaaagccgaaagcggcgtttatattcgacgtgtatggagaaatcccgactaccaaaccagtgtttgaagcggaacattatctggggagtgacattaccggaaaatggaatactttcatccagaattatacgcatgagtatgatgtaacaatcggatttacggattcttcggtcgaaattttgaagccttctatttacaaggcggttaataaggtgaataaatattataagaaggcattgaagaaagaagaggtgagccgggaagttgctacattcaacatgggtcatattctggattgcgccaatgtgatgtgtttcgatgataacagcaagtcttttgaggaggctctcaagtcggcagatgaaccggaagaaattatcgcattattcaatcaggttactttaagaaagttataagcaatgaaaaagatcaattttagaaaaacgctgtttgcagcggttttgcttttccagctgaacgctattgccgcctttggtcagacggtggtgaaaggtagtgtgaaagataatacaggtaaacccatcagcggtgtagtggtgacagacggggcacatttcaatacgactgatgcagaaggaaattatgttctgaacactgatccgacacgttatccaatggtttacatctctactccggcagcgtatgagcttccttccaaagagggggtagccgatggtttctatcaatatctggatgccgggaaaagcgagaaccaatgtgacttcgtattgactaaacggcagaaaccggtggatgaatttgtctacatcgtcctttccgacccgcaagtgagaaacgaaaagcaactggaccgcttccgcacggaaacagtgcccgacctgaaacagactgccgactcactaaagaacttcgaaatcgtcggcatgggactgggggatctggtgtgggatgccatgaacctgtacgctccttaccgtcaagcggtgtccaacttaggaatgacgatgttccaactgatgggaaaccacgacttcaacctgctctacaaatccataacgcagacggatcatccggcggatggttatggggaacagaattattatcagtcattcggcccggccaactattcattcaatatcggtaaagttcatgtgatagcaatgaaggatattgattacgacggcaacaagaaatacacggaacgcttcacgccggaagatttggactggttgagaaaggatttaagttatgtgcccaaaggaaatatcgtgttcctgaacgttcacgctccggtagctaataacacggtagctgcgggtggaaatgcgcgcaacgccaatgcgcttttccaactgttgaggccttaccaagtacatattttctccggacacacgcacttttatgaaaatcagtcgcccgctcctaccatttacgaacataatatcggggctgcttgcggcgcatggtgggcaggacacgtgaatcgttgcggagcaccgaacggttatctggtggtacaagtgaaaggtgatgatgtgaaatggcgttacaaggcaacagggtgttctcccgactatcagttccggctttaccaaccgggagagtttgaaagccagaaagactatatagtagccaatatctgggattgggactggacgtatacggtaaactggtatgaggatggagtgttgaaaggtgctatgcaggcttttgacgatgaggatcaggattatatcaatatggtaaagggaaagaaaacgggttatcgcacacgtcatcttttccgtgcacagccttccaaagatgcaaaatctgtcaaggtggtggttaagaatcgtttcggggagatattcacggaagagataaagctgtagtttctcctacgaaacacaaataagtattgattcctgacatcctaccatcgtgacaaaaaatagagtttatatcatccggctacgaaaataaactattgtagctatccgacataaactctacttttttcaaacctgtcgcctacctcttatatctttataaatatttgctttttgtacagcacccatacaattagataattgaatccgataaacagaagggcgtaaatcagagaggccagatgagcatcgggaagaacgctccaaatggaagtgtaaatcttctcctgcaagctactccccccaaccgtaattacttccagcaaagtagctaacacaccggccactatataaataaacaatggattcgtaccaaaaacatggaaaggatatccccatttctgctttttacgaatatcaatcagccaggtgagaaacacaagcaacaaggaagcaaaaccacaagtcaccagcacaaaagtcggactccatactttcttattcaacgggcagccgtaactcaacaaccatcctgcaaacaaaagagcaatacccagtatggagatctgcaacagccggtgatggatttcagtcttctcccgcaaaatatttccgcagaaataaccgataatcacttgcgcaatgcacggcaaggtactcaacaggccttccgggtcgaaaaagatacgcccgccatccggcaaccactcccgatacaaatgggcttctccgaatagtgtgcgatctgtaacggcaataatattctgttcggaaagttcaaatccgtgtcccaaagccagcaagatggaataacctgccagaatgatcccggagatccatgccagatttgccggacgccggacacccacaatcagcaaggaaccaaagaaataagccaatgccaaccgctgcaacactcccagaatacgtatgtgcgagaaaggttgttctactcctgtgcacaccaacgagaaccaagaaagaaaaagtcccaacaaaaacaagatcaccgtgcgccgtaccagtttgatgataaaaccgcgactgaaatgatgatcgaaccgggataaggcaaaactcatggaaacgcccattataaacatgaagaacgggaagaccaaatcagtcggagtcagtccgttccattcggcatgtcgcaagggtgcgtaaatggattcccatgttccggggttgttcaccaaaatcattccgacaatggtgattccccggagtatatctaatgaaagtaaacgttctgatttcatattgttcttagtgtaccgggattaaagaaatcccggtttggtgaaatagaatccattcgcattcaaccatttaacatgccatttcaggcgattggtaaaatcaatccagttacggctacttccccacgccaactccgaaaatgcttgaagagagggaaacacgtgctggccaaacttccgttcattaggaatcatctccgtccatacacaagcctggaagcctaacacattttgcttcacgatgccgggaaactggggttcgaactcgaagttatacaaagagcttaatccttcgtctgaaggcgttgcactcaaatagaaacgggaccattccatgaatataatcggataccctttctgggtaatctttcccggctgatcgggcagccagtcacgccaataagtataaatcaaatcctgtggctctttttcaagaaaagcatcgtcccatcccatcactttcttgcctttacccttcacatagttcgtcataatcttcacaaaacggttttgcagttcatccactttctgataaccttcctgctgcatcaatcgctgacaaacttcacactgttcccagttatctttctccacttcatctgctccgatatggaaatattccgaagggaaaatctcgaccatctcatcaatgatggactgcacgaactgatagttctccgggcgcgagggacagataggataagagaattcttctccccatccggcttctcccgtgcacgacaactcgggatagactttgatagccgccgagaaatgacctggcatgtcaatttcgggtacaatatcgatccctctttccaacgcataacttaccaaacctttcatctcttcctgcgtataatgaccaccatattgagaaccgtttctcacgaaacggggatctatctcatagttataatcctgttgggaaagttctacgcatctcttgtcatattcgtcaaagtcgcgccagctgccttcctgcgtcagcaacggatattttttcacttcaatgcgccaaccctgatcgtccgtcagatgcaagtgaagcttgtttatcttgtagaaagacaaacagtctatcacctttttcagataatcaaccgtaaacatgtggcggactacatcgatatgaaatccgcgccaatcatatttgggagcatcttttatatcgaccatcggaagatatttagcacttccggaagtgaagaaatttgcttgttcgagcgcttgtctcaatgtctggattccccagagaagtccggtttccgttgaataataaacgcaggctccctctttggtaacggtgagccggtaagcctcttttgccaaatccgattcctgtttcacacggataaaggcacgatcgttggaggcatcactgacggaaagagaaagtttctcttccagggtggatttcaacagttgcgacgtggaagccggaatgttctggctgacagtcacattctgcggaagagagacaaccgattctttataatcgactctttccggcaaaggcatcaccgacaggcgggtgggcactcgctccgggtagttcccgttatcattatcattgcacgacaacgatgtgatcgcacctattcccaacaagaataatattccggttctttttatcttatcatagttcataacttatctacttttgtggattaatctactttgagagtgcttgttacactctctttatttaaataaaacagtttcgctttcacaacggaagcatcacaggctacgggagctttccaaagttccgaacgaagggtcggttccgtgccatcggtcgtatagcgtatttcacctccccggataggggtactggcatggagttgcccttctttgatgcaaagtccgggatgaggtaaacggaaattgatacttcgggacgcccagtgaggcatttctttctcactcactttggagtagaacaggcccagttctttattgaaagcctgacgttctttctctcctgttaaagtgctccaggcgggaaaagcgttccaaccgcgttccaccaatccgaggattttggggaaggtgtaatattccacccattcaaaatcacggatggtttcagcaaataattgtgcctgcactccctggatatgttcctttccggaagcggtcaaagtcgtttttccctttcctgcgatgtccggatcgaccggattgcctgccatatcggtacgcgaagaacgataaatgctatatggaagcatggagaaacctttggactcgtcgacatatcccgcccacgagagacctctttcgtcgggatgagcgtcataggccaaatccagatagaaattgttcacgttgcagagaatcaccggatatcctttgttagctatctggtaaggtatttcatccgcttcccattcaggaaccgtattccagcaatacactcctgctgcaagttggttcaaatgccgatcggttgtttccggatgtcccaacgctacttcctgccagccgctgaattgcaaatgatgttgttgcagatagtctgccatcttcgtaatatagtattcagacagttcgtgggcacttgtcatcccgttttcatccataaacgtccggcagacaggagaacccatccaggctccttcgggtacttcatcgccacctaaatgaatcgtagtcaaaggtacctccgcttcctcatacatggctatcaactcacgaatcactttttccataaaccggtatgtagaaggcaatgctacattcatgacattatccgtataagactgcgcggaaacataacgggaagtgtcttgtgcgtcacttaataaatattcgttggccttttcaggggcagtattcacatacttatgatagcgcgctttcatggacacgattgccgcacgggcatgtcccggagactcaatctccggaatcacacgcacatgtctttgagctgcataacgcaataaatcgataaattcttcacgggtgtaatatccgttgccggaggtagctgcagacggatcatagttgccatcgtagcccggatataaacattccagttcatccgtggtatgtccccggcgtgcgccaaccgaggtcaattcttccaagccgggaatctccagacgccagccttcatcatccgaaaaatggaaatgcagtacgttcagtttataagaagatattacatctaccagctttttcagatgttcaacagtcgtaaagttcctggcaatatcgagcatttgcccgcgatacggcaagtcgggataatcgcggatggagagagcttccaaacgaaacggcttttcctgacctttcaacagggagagcaaggtttgcgtcccattgaaaatgccatgtgaagtggaagctgaaatatttatcagcccgtttcccgtatcaatccgataatattcgccgttcactgctgtttcccgttccggcaaataatccagatgaactgttaccggtgcttcggatacaacttccaggccatggatggttgccagcttttctttcagtaattcagcttcgttggcaaaatcgggatggaaagtcaattttactttattttctatagcaaaaccctctttgccggtagccggcaccgcttctttcactgacggaaaaatatcagtttgctgcaactgggctgtagtctccaacgccaaattcgaagcatatatcttatcaggtgcgggataccagtcttctgtctccattcctttcagcggctgtatggtcagtccgacaggcaagggaataccttgtttactgcctgactgactcacccagtaagtgccttcgggagcatgtgacatttttttcaatccgttggtacaacagaatttgacggtcaacgaatctcccggagccagtggttgaaaattttctgccggatacatccggaagaagttcgcattcaccacttccactttgaccggagcagactcttcctgcagaatctcacgaggcagctgcgaataatagatgatccaatcctttcctaaaggaacatctgagatgttcttcaggacaaatgaattctcatagtaaccgggctgtacttccacagctcccatcttccaagtcaatgacacgggggctttcgccccgtcagtcgatttacaaccggaaatgaccagcaggaggcacagacttccccatattgtatatagcatatttctcataggctttcctgtttttctatatatcattcttttaggtattaatcactcaatcgttcgatgtgcaaagtttctttgcctactccctgcgaggcgtcgaaagtcagacgataatagccgggaacgaaaccatcgccactcgttattccattggaaccagatagttcaattccatccgtatcgccggacaatgaaccctcttgcagtagcatgcctttatctttattccattgcaaatcgctgtaaatttcaatttcgaaggattcccattcatgagtgttactcaaatacacggtggtctggtatttctgttcaccgattggcacaatatatcctaactgtgatatgtcttccaaattccagcctccactattatatgcttcattccagacgggtgcgcatgtaaatccgtgtcctaccagccagaagcaagtgggagccgtatcacccatccgtgccacccagatataattatacttagaagaataatagatctcccaggttcctgatttgcgcaagaaggtaaacttgccattatccggattatagctaaagaagtcgcgattgtaagcgtgttccacatcttcaaatccactcatttcgaactcttccccctgcgtaaagctaatctgcgcacggaaaaatccctcactggctatcaactcggtttctttaattttcaggttcttttggtagccgactactcccagttcaaaagtcatcacattgaaagtgatttgttcgacaaaccaatcccggtaatcaaaagcaaagctgggtcccgacgcttcaataaggactgccgtattgcttgcttcggcagctccccaaatcagttttgcatcgtccaatgatgctgcgctagagatctttccggatagttccatcggataaccctcttccgaatcggaaacttccgtgaggtacaggtaaggattgtcctcactccggttcatttctaccacctcaccgttatagtgaagataaagcacttcgggaatctgcggacgggttatatggaaatcaaatgtttgagtgacttcactaccttccacattaatggctgtcagaatcaccttcgcttcctgattctcttcaagtccggcttcaaacgggatataaatccctttttcaacaatcgagacatcagtgcctttcgtacggatcgactgcgaactgaccaaagtttcacctgtcatcaatttcacttccagcgtagacaaaggagtctgcggatcgtgaatcttcacagaaaaataaagagaatcggcagcaggtgtctgatcggtagttgagaattgcagttccgatatttcgggacacgaatatggatacgtcacccggccatcttcttcgctgcatgaagccagccaacaaacagtcagccccagcagccataaaaacagattattgtgtttcatcattttttcttttaaagttttacgttcctcttttcattaatagccttcattttgagtcagattgttgttcttatctttctctccttgaggaatcggccacaactgccgaaaagcctgcaaacctgcaaacagcaatctgccgtctttgtctttatgcttctgcatcacttccagcaaacgattattgcgtaccaggtcgaaccagcgctgaccttccatatacaactctaattggcgttcgttctctaccgccaggcgtcctctagcctgccccatattttcatctaaagaagaaggagcaaaaccggcacgttctctaatgctgtttacaatccggatggcttccggggtgcggtccaactctaccagtgcttcggctttcaacagcagtatatctgccaaccgcatcaaaatgatattggaagtcttctcgcgaatcttataagacaacgggtaactgtctgccggccaataggtatcataaggcactgatttccaaagaatactggatgcataacgggtatctttctctttgtcaaatttagcaaccagatcatgagtaggtgtacaataacgtcgccaggttactgatccgtcatcttctttcagcaatacccagtaagcccagttgggtgcatcggaggtgtaatagacttcgaagatgctttctgaagaaaatttcttatcgggttgccacaactcgtcaaaattactgaccagcgtatagccttctgctattactttgtcacaagcctcaaccactttggtatagtcgcgtgttgatttctcccctctcgttgctaacactttggcacgtaaagcataggctgctcccttggttgcctggaaaattcctttattcttgcttaccaggtaacgaatggtattttcttcattcaggtcgtccaggatctggtcatatattttatctgtggcagaacgttccggatacatcaccggataccatttatcgaggttttcggctgtaatggtcggaatcaaatccagcaccatcggggcatcaccccataaacggacaatatcaaaatacgcccatgcccgcaagaacttggcttctgcaataacacgattacgttcttctgctacggtagaagtaggatccatcatcttcgtattttcaatcacactggttgcagtgcccgccatcgaataatactgtgaccagaccagttctactttataattggtagaggtcagtttcaacaaatcaaactcctgttcggccacaccatctccgccgatataacaattatcggactgcacatctccaatagtataattttccgactggaatatatctgctttaaaactctcatacgcaccctgcaactcggcctgtgcatctgccagacttccatatttagactcctgatcttccgttccggtaccttcctgcataaaatccgattgcggtttctcatctaggaaactactgcatgaaacgactaatgtacagagtacgacatacactaaatttattatgtttttcatttttgcagctattaaaattcaacattcaaaccaaaaattaccgccctcgattgaggataagtaccatagtccaccccttgagcaacggagtctccgccaaaagcatttacttcaggatcgtatcctttgtattttgtcagtgtgaagagattctgtccggtgacgtaagcctgcaatctggacagatgtatcttattcaaccatttcttaggaaaattataggataaagtgactgttttcaggcgcagataagatccatcttctacaaaacgggaggagttatgattattctctgtattaccaacgcgggggacattggtaatcatacccggtcgtttccaacgatccaacacacgaaccgactggtttctaaagtctgtcatgccttccatatcaatacgcgatgcattaaaaatcttattgccctgacttccctgcaagaatacagacaggtcgaaaccggcatacgaaaatgtattcgtcataccgtaaatgaacttgggctgggcatttcccaaagtagtgcgatcttccggatcgataaaaccgttaccattcaagtcacgatagataatatctccggtttccggatcaacgccttctgatatgtaaccaaagaatgtgcctaacggaagaccttctttcaggatgacggctttctccttggattcgtacatttcagcataataataaactttattcaaaccgagcttcgtcagcttattccggttgaaagatatattgaaatcggtattccactgaaagttacctttaaaattctgggaagagagagtgaactccatacctttattcaccatctcaccgtcgtttcttgtcacactgctcggcaccacattctccggcaggctgactgtcaatagtaaatcggtggtctttttgtagtaagcatcaaccgagaaggataagcgggaatcaaacatggtcaggtcgagtcccagattccattggcttgttttttcccaggtcagttctttattggctgccgagccgggtttaatggcaagtcccggatataagtttccctccgaaacgggcagtttactgacgctcatggaagccatgtaagcgtagtttccaaaaccgccttggttaccattcataccccatccggcacgtaatttcaggtcggtaacaatgtcttgtaaaggttgcatgaacttttcgcctgaaattctccaacctgcagaaacagaagggaaagtaccccaacgatgtcccggggcaaaacgagaagaaccgtctgcacggaagttaactgtcagcaaataacggctgtcgtaattgtaggctacacgacccagaaaagaggccagcgtccatgcggaagcagaagaaccgcaagcatccttatccagttgattggcggcactgatggaatgaatatcgggataagactctgccaggtcgaaacctgccatccacgaaccgttatattgtgcacgctgctgggtagcccctcccaaaatagaaaggttatgtttgttgaatgaacaatcataggtcagcaaattttcaaaaagccattcaaagtttcgtgagaaactctcttccacacgtccttttgtaccccgtccgtccgaagttgaaatcgggtccagatagtagtcccaatgttcattggtcagttcaatgccaaaagtggttttaaacttcagtcctttgaatatgtcaactgtgaagccgagtgaaccatttatatggtctgtattcgtgttactatctgcagcattggcagccagcggattcagaatacgtgcaccgtaagcctgttcgtcatattcgttcggatcatacggattccatttctgcataaacggaggagtattcacaacggataagatggaaccggcacgcaaagaactacggctttcgttcacccattgtccgcctgtatgcgaatatgcaaaattgagtgccatctttagccatttggtctgctcactatccaggtttgcacggaaattataccgattgaaatgtgctttctccacaataccctgttcgtcggaataacctccggaaacaaaatattgcagtttctcggttccatttgccacagacaactgatagttctgattgacacccgtaccgaagaataaatcagtccagtccacatagcgcgtttcactttcggggatattgggggcaacatccgaaactgctttcaaatctttcatcaagtctttatattgttctgtattcaacgcatctatttttttccctaatttagagaaacccacataagcactcattttcacttgcggtgcaccgatctttcctcttttagtcgtaatcaacactactccgtttgccgcacgtgctccgtaaatagctgccgatgaggcatctttcagaatttgcatgctttcaatatcattcggactgatattcgaaatgtcatccgacggcaaaccgtccaccacatacaacggttcattggatgcctgtaccgaagtggctcctctcacccggattgtcactccggaacccggcatacccgacggctgtacaacctgaataccggctgcctttccctgaatagcctgtgcagctgtcataatcggacgttcttcaatatctgccgtggaaacgacagataccgcagtcgtaatatctttccgtttcataaaaccgtatcccactacgactacctcttccagtacctgcgaatcttcgctcaatgacacattgtatacgttctgcttattgaccgtatgagattgggaaacataaccgatataggagaaactgacttttgcccccacaggagcttccaaagagaaacgaccgtctatatcggtagcggttccaatattctctccctccactctcactgtgacaccaatcaagggttctcccctccggtcggacacaacaccggtgattgttttcttatcgcctttctggggggcgttctgttcacttttcagagtaagcaccacttgcttacccgattctattttataactaatagatgatcctttgaaaactttttctaaaaccgcatcaatactttcattactcactgtcaatgaaattttttgatctaatccgggaagcttatccgtataaaaaaagctgtaatcagccttcttttcaatcactcgtatcgtctggcgtatcgtctgattcttcacagagaaagtgatctgcgcacttgcctcttgagacacaaacaacaagatacaactgaacataacaagcctgaatatgatatgtaattgttttctcattagtaattagctttaaattctttaaaatataagtctgaaaattagactttttattatctttgtaaaatcgtgaagcaaaaaggattccctttcccttatccgcataaggaaaatttcttttttactatcatgtataaaccgtatttgatttcggggtggaattatgctgctacataattctaccctctttattttattatgaggtgtcttccataaattgtcctttttagttaatactacttcctattctcaccgtatctccttctaactcataggttaaaggataagtaaggcttataatgtaaaatacattatgcaagctactgttccggatggttccggaaaatagcacgttcttcagtttctcggagtcaaacacgactttcactccgtacatccgctccagcgtagtcgcgatctccgctaaagaggatgaattaaaaatcaacatattgttccgccaaaagtcgatttcacgcatatccgagattacagatttagtaaatgtctgcttgctcttatggtattctaccttttccccgggtttcaacaaggttacgtccgttttattagaaaccttgacgcttccttctgccagcagtgttgtgacagaatgatcgtcacaatagcctttcacatcaaaggtggttcccaacgcttctatctccagatcattgcagcagacgataaaacgtttatctttgtttttcgccacttcgaaataggcttctccgtccaaatagattttccggtcggatttgttgtactccgcatcataagaaagatgagtagccgaatttaaccagactttcgttccatcgggcaaagtcagattcgctttctgtccataatcgacagccaccatgaaagggtcctgtgacaccttattcatgtgttctaccccaaagtaagtggccagtcccaaacaaaccggtaataagatagtggctgccaccttatatataataggttgccagcgccgtttcttcggagatagtatcttgggctcatccagattcctctgcagatggttccacatttcttcttccactgtcttatcgatttcgacggctgcttctttccacatttgctcgcaaagcagattaaactcattacgaattccgggtttacgaatccattcaataagtatccttctttcttcagaagaggcctcctttttgaagaatttttccaatagtactatgtaatcgtgttgctccataattttcctgttctatttatactagtcttgagagacagaaaaggactacagagaaatcgaaatagttcagatattaacttttattaaaacttctatattagatatcatgtaagaagagagagactgaaaaggtaattattcccagtttgtcacgcaagaaatccaaagaacggtgtacctgtgtggcaacagtcttttccgagatattcaattggtcggctatctcacgatagttcaaccctgatttccagtaaagcataaaaacttcccggcgcgctggaggcagttcttctaaaagtttcaggatatattcttccaaaaacaaataatccagttcttcatctatctctacggattcgtcagatgactcattcgcaagcctgtctacataattttgaagcaggagttcgcgtcttacataatgatataccatgttttgggatattttaaaaagatagccgtcaaaattcccttccagatcgatattaagccgcttctcccagatatggagaaaaatatcttgtgtgatatctttcgccaccccggcattgctcaccatagaaaggacaaaattataaatgcgagcattgtatccacgatacaatgcctcaaaagcatttttatttccttctttcaataattgaagttgctgggtggtaatcattataaaataaggttaaatcatatatcgattcaaaaatagcgaaataactaaagccgacaaccaaagcacttgttaaaatttcaataaatcaatatcatagcatttaaaagggaatagaatacaaaaacacatccttgacatatcatatcataaattcagccattttgctataaaattaatagaaattattaatcaacagctacaatttcgaacttttattcctacatttgcggtcaaatgataacttattaacaaatttcataaataccatggctaaaataacgaaagaagccgctttgctctatcattcacagggcaaacccggtaagattgaggtagtgcctaccaaaccttacagtacacaaaccgacttatcactcgcatattctcccggtgtagcagaaccttgtctcgaaattgagaagaatccgcaagatgcgtataaatatacggctaaaggtaatctggtagccgttatttccaacggtacagccgtactcggactgggtgatataggtgcattgagcggtaaacctgtaatggaaggtaaaggtctgcttttcaaaatttacgcgggcatcgacgttttcgacatcgaagtggatgaaaaagatccggagaaatttattgctgcagtaaaggctattgctcctactttcggaggtatcaacctggaagacatcaaagctcccgaatgttttgaaatcgaacgtcgcctgaaagaagaactggatatacctgtcatgcacgacgatcagcacggtactgctattatctccagtgccggtttggtgaatgccctgcaagtggccggaaagaaaatcgaagatgtaaaaatcgttgtgaacggtgcaggtgcatctgccgtatcttgtactaaattgtatgtgtcactgggtgcacgtctcgaaaacatcgtcatgctggatagtaaaggcgttatcagcaaggcgcgcacggatctgaacgaacagaaaagattttttgcaaccgaccgcacggatattcacacgctggaagaagcaatcaaaggtgcagatgtattcctcggcctgtcgaaaggaaatgtgttaagccaggatatggtgcgcagcatggctccgatgccgattgtgttcgcattggctaacccgacaccggaaatctcttacgaagatgccatggcagcacgtcctgacgtactgatggctaccggacgttccgactatccgaaccagattaataatgtaatcggtttcccgtatatcttccgcggtgctttggatactcacgctaaagctatcaacgaagagatgaagattgcagccgtacacgctatcgctaatctggcaaaacagccggtacccgatgtagttaatgcggcataccacgtgaacaacctctctttcggcgcggaatactttatcccgaaaccggtagatccacgcctcatcaccgaagtttcctgcgcagtggcaaaagctgctatggaaagcggagtggcccgcactgaaattaaagactgggatgcttactgtgttcacctgcgcgaattgatgggttatgaatccaaactgacccgccaactgtatgatacagcccgccgttcaccgcaacgtgtcgtatttgccgaaggtatccatccgaatatgctgaaagctgccgttgaagcgaaagccgaaggtatctgtcatcctatcttattaggaaacgacgaagctatcggaaaactggcagaagaaatggatcttagcctggaaggtattgaaatcgtcaatctccgtcacccggacgaatcggaacgccgcgaacgttactcacgcattcttgcagaaaaacgtgcacgcgaaggctttacttatgaagaagccaacgataaaatgttcgaacgcaactacttcggtatgatgatggtggagacaggagatgcggatgctttcatcaccggactttatacaagatatagcaatacgatcaaagtggccaaagaagtaatcggtatccaaccgggcttcaaacacttcggaacaatgcatatcctgaactccaagaaaggtacttacttcctggcagacacactgattaaccgccacccggatacggaaacattgattgacatcgctaaattgtctgataaaacagttcgcttcttcaatcacacgccggttatctcaatgttgtcatactccaacttcggtgctgatactgcaggtagccctgtgaaagtgcacgaagctgttgcccacatgcaggaagaatatccggaactggctattgacggtgaaatgcaggtaaactttgccatgaaccgcgaattgcgtgataccaaatatccgtttacccgcctgaaaggaaaagatgtaaatacattgattttcccgaacttgagttcagcaaacgccggttacaaactgttgcaggcaatggacccggatacggaattcatcggccctatccagatgggattgaacaaacctattcatttcaccgatttcgaaagctctgtccgcgacattgtcaatatcacagctgtagccgtgatcgacgccatcgttgacaaaaagaaaagaggaggtaaatgaaacgtccgttatccaaatcacaaatagtttgcatcagcctactttggttggcgctttgctatctagttctgacaaaagccgaacgaattgacgggatgacggtggtaatgcttggcatttcggcagcattagtgtttattcctgtctataagtcgatcaaaaagaacaaataaatatcttttttcctatttttaatgcgataaaatatcaaatttgatgttttatcgcatttttctttataaaatgtttgctagttcaatttttatctttacttttgcaaccgaaaataaatatccgatgtacccatacgcagatgtgcaaatctgctatatagcacaaaagcacatagtcaaacggtatattagcaaattgtcaaattagcactttatttatatcaaccaattaaagaaaaaaaagattatgaatgcagcaaaggtattagacgatctgaaaagaagatttcccaatgaaccggagtatcatcaagcagtagaagaagtactttctactattgaagaagaatacaacaaacatccggagtttgataaagtaaacttgatcgaacgtttgtgtattcctgatagagtatatcagttccgtgtgacttggatggacgataaaggtaatattcagaccaatatgggttaccgtgttcagcataacaacgcaatcggcccttacaaaggcggtatccgtttccacgcatctgtgaacctttctatcttgaagttccttgcctttgaacaaacattcaaaaactcactgactactctgccaatgggtggtggtaaaggtggttccgacttctctcctcgtggaaagtcaaatgctgaagtaatgcgcttcgtacaggcattcatgctggaactgtggcgtcacatcggtcctgaaactgacgttcctgctggtgacatcggtgttggtggccgcgaagtaggtttcatgttcggtatgtataaaaaactggctcatgaatttaccggaacatttacaggtaaaggccgcgaattcggtggttcactgattcgtccggaagctacaggttacggtaacatctacttcctgatggaaatgttgaagagaaaaggaactgacttgaaaggtaaagtttgtctggtttctggttctggtaacgttgctcaatatacaatcgaaaaagtaatcgaactgggtggtaaagtagttacttgctctgactctgacggttatatctacgatccggacggtatcgaccgcgaaaaactggattatatcatggaactgaagaatctgtaccgtggccgtatccgtgaatacgcagaaaaatatggttgcaaatatgtagaaggagctaaaccttggggtgaaaaatgtgatatcgctcttccttctgctactcaaaatgaattgaacggtgaccacgctcgtcagttggtagcaaacggttgtatcgctgtatctgaaggagctaacatgccttctactccagaagctatcaaagtattccaggatgcaaaaatcctttatgctccgggtaaagctgctaacgccggtggtgtatcagtatcaggtcttgaaatgactcaaaactctatcaaattaagctggagcgctgaagaagtagacgaaaagctgaagagtatcatgaagaatatccacgaagcttgcgttcagtacggtacagaagctgacggatacgtaaactatgtgaagggtgctaacgtagccggattcatgaaggttgctaaagcaatgatggcacaaggtatcgtataatcagcaaaagatatataagctatagtttatttaaaagctcccgtcttccgtgaaggaagtgcgggagtttttttatgcaataaaaagatgtacgccccccgggtgtcagcacaataatctttgtagaaaaataaatagcagacaatacacacacaattcatagttattctctatctttagatagaaattatctgtttgacaagcgagcaaaagaagcctatctttgttatatattataaaccccggatgaaagaataaaaggaaacagtctgcttatacttgtatccgactaaaaaatctatttatggaaaagaaaaaacttactgcagcgaacggtcgtcctatcgctgacaatcaaaactcgcaaaccgcaggtcaacgcggacctgtaatgttacaagatccctggcttatagagaaacttgcccattttgatcgtgaagtaattcctgaaagacgtatgcacgctaaaggttcgggagcttacggtacgtttactgtcacccatgacattacaaagtacacccgtgctgctattttcagtaaagtcggaaaacaaacagaatgttttgtccgtttctccaccgtagccggagaacgtggagctgctgatgcagaacgtgacatccgtggttttgctatgaaattctatacggaagaaggtaactgggatttggtgggtaacaacactcctgtattcttcttacgtgatccgcttaaatttccggatctgaatcatgccatcaaacgagatccgaaaacaaatatgcgtagcccgaacagtaactgggacttctggacgcttttaccggaagcattacatcaagttactatcactatgagtccgcgtggtattccttattcatatcgccacatgcacggattcggcagtcatacttatagttttatcaatgcagaaaatcaacgtatttgggttaaattccatctgcgtaccttgcagggtatcaagaatctgacagaccaggaagcagaagcaatagttgctaaagatcgcgaatctcatcaacgtgatctcttcgagagcatcgaaaagggcgattatccgaaatggttattccagattcagttaatgacggaggaagaagcggacaactatcgtatcaacccgtttgacctgactaaagtatggccgcacaaagatttccctctacaagatgttggtgtccttgaactgaaccgcaacccggaaaattattttgctgaagtggaacaagctgctttcaacccgatgaatattgtagacggtatcggtctgtctcccgacaaaatgttacaaggtcgtttattctcttatggcgacgcacaacgttatcgtctaggggtgaatgcagaacaaattccggtcaacaaacctcgttgtcctttccacgcctatcatcgtgacggtgctatgcgcgtagacggtaattacggtgctaccaaaggatatgaaccgaacagttacggcgaatggcaggattctcctactatgaaagaaccgcctcttaaagttaccggtgaagtttacaactacaatgaacgggaatatgatgacgactattatagccaaccgggtgacttattccgactgatgccagctgaagaacaacaattattgttcgaaaatacagctcgcgccatgggagactccgaattgtttatcaaacaacgtcatgtgcgcaactgctacaaagccgatcctgcatatggaacaggagttgccaaagcgctgggtattgacttacaagaggctttgaaagaataatctgctatcactttcctctacaggtactccttcttcccaaagaaagagtacctgttttcttataccccataaggtataattcataaatctacaactaaatttataccctaaagggtgtaaaatagaaaatttacattatctttgtacccaaaagggtataatatgaatgataaatcattatcagaatacgtcaagcaaatgcgtaaagaacataacttgacccaagtagagctgtccgaaaaatcaggagtcgggttacgttttgtacgcgaactcgaacaggggaaacagactttgcgtcttgataaagtaaatcaagtgcttagtctctttggaacggaagtgggtgttgtaccaataagtaaattcaacaagctatgagacaagcactcatatacaaccaagaccagttggcaggattgcttacagaagatgaaaatggctatacctttcaatatgatacagcctacattaaatccagcgatgcggaatctatcagcctcacactgccaatctcggaaaagccatatacaagtctaatattattcccattctttgacggtcttattcctgaaggctggcttttagatattgctgaaaaaagttggaagataaatcgacgtgaccgtatgtcactactgcttgcctgttgcaaagattgcatcggtgcagttagtgtgattcccatcttaaataaagaataatgatgagcagatgcctatattgttatcaggaacttggcgagggagaaactgattttcaccctcaatgcggaaagaaaatatttgggagcaaaacagttcctctcctaccttatacaaaagcggatattaagcaacttgccgaacaagtcatacgctcacaaaccacacttacaggagtgcaagcaaaattgtctctcgatatatcatcgtcccccaaccaaccgcaacgctttactatcgttggtttatggggacgttatattctcaaaccgcaaacggaacaatttaaatacatgcctgaagttgaggatttaacgatgcatcttgccgaattggctaaagtgaacgttgtccctcattcattgattcgttttgccgatggcgaattggcctatatcactaaacgcatagatagaaccgcaaagggtgaaaagttgccaatggaggatatgtgccagctctcggaacgcctcacagagtataaatataagggctcttatgaaaagatagcaaagataattatgcaatattcctctgtgccaaaacttgacgtaataaatttctgggaacaagtcgttttctcatggctgaccggaaatgcggatatgcatctgaaaaacttttcactttatagtcagcgtaaaggctattattcactgaccccgggatatgacatgatctctacggcactcctcatgccggaggacactgaagaattggctttgacacttaatggaaaaagacgcaaaatcaagcgttctgattttgaagttgccatgaatagttgcagtttagagaaaaagatcatagacaacctattttctaaatttaccaaagttgccgaaaaatggttagagttcatagatatttctttcttgcctaaagaaatgaagcaacagtacaagctgattataacaagaaggtatcaatccttctttgatgcgcaaatataaaaacaggctaatacaacgaaatgacatgaaacttagagaggataaaattctaaacataaggatctattaattagatatttaatagttcctttcctctcgctttaagaaagagggcttccgaaaagaagcggacagcctcttttatatatcattaccgacaactctgatttttcttttaacattctacagaaatagccactcaactattttaactatctttgtcccctgtataaccccttaatatttataacagactgatgaaactaaaaaatttattcgccggaatgatattatgtctggcagttgcttcctgcattcaggatgaagctcaaaatgttgaagcagctatagatggatgcagtggaaaccatatccaacagtacttgattgatcgaaatgacttcaccattcagttgtatgtatcaaaagctgctgacccatccaaaacaaacatcaatttcgacctccctactggagcttctataaagccggtacggcagttaaccggagacgaagctaacgtctataactttaatgacgaaaaccctagagaatttaaagttacatcagaagatggtgctttttctgcgacctatacaatcaaactttggcagacagaaatgcctttagtatacgatttcgagacgctaagttcagatgctccttatcacaaattctatgaagataaatcttctgaaaatattatccgtcgactagagctagctagtggaaaccctggattcgaattaacaaaaatggcaaaaacaccagaagactaccccacggtacaagtaaacggaggagttaatggcggcaaatgtgtaaaactgacaacgaaagacacaggtagctttggaagtatggtaaaaatgtatattgctgcaggtaacttattcgttggctcatttgaagtgggacaggccttaaacaacgcaatgaaagccacccactttggtttcccattcttctactatccactcaagttggaaggatggtacaaatataaagccggtaccaacttctcatcaaagggagaaatcgtagaaggaaagaaagataaatgtgacatctacggtgtattatatgaaacagatgataatgtacaattccttgatggctctacttcactcacttcacccaatattgtagccttggcacgaaatcttgacgcacttcctgaaacagatagttggcaacaattcagttttaatttcgaaccaaagaatagcaaatctattgatcctgataaactagagaaaggtatctacaaacttggcatcgtattctcttccagtgtagacggtgcaaaatttgagggagcagtaggtagtacgcttcatatagaccaagtagagattgtctgcacttctaacccgagtgaataccccgcaaatcaataataaacccaaccaattgataagataatgaagaaaacaatatataataaagtagtagggattgtattcctcgcaatacttttttcacatgttgcatatgcccaaaacgaacgtaacaaagctcttatctactcatatttacatggatgggagtatagtatcaaagccggattgagcattggaggtacttctcctcttcccctacctaaagaaatacgtagtattgatagctatgcgccaaacatagctattgctattgagggaaataccacaaaatggttcggcaaagacaaaaaatggggaatgaccgcaggtatacggcttgagaataaaacgatgactaccgaagctaccgtaaaaaattacggaatgaagatcatcaatactaatggtggcgagctacaaggtctttggactggtggcgtaaaaacaaaagtgaaaaattcatatctcaccattcctgtattggctaattataagataagtgaccgttggaaagtatcacttggtccttatgtttcttatatgactgaaggcaacttctccggacatgtatatgaaggtcatctacgcacgcctgatgaaacaggccagcgtgtcgacttcaacggtgaaagtattgcaacttatgatttttcagacaacttacgcaaatttcaatggggagctcaattaggcggtgagtggaaagctttcaaacaccttaatgtctatgcggatttaacatggggactaaacgatatctttaagaaagactttgatacaataacatttgcaatgtatcctatctacttgaatattgggtttggatatgcgttctaaaagagtaacagatatagaacaggcacaatgcagtgcacattacagccgtttttaatataggattcttatgtaccaagaagtattctactaaaaatatccccgctacaattcaaatttgtaacggggataaatattttttctaagaggaacactcaatatattaataatattattctccgatgatttctagttcgtcaacaaataatgtactattaaccgcacctttaaatgagtctccagctttacttgatgagcaaacaatagccattttatatttttttgatgaatcataaaccttaccttcaaaataagtaaatgcttcattaaattcgacccatttgtcttctgtatccgaaccatcttttatttgcgcaatagctacacgatattccgaattagttatcgtattcccatccagtataacttcttcttctttttcatttgtagcttcatacaataaagcataaattccacattgatctttatcacctgtattttcttttacatcatttttatcagaaccatctacaaaattgtccccagctttatacttaaaggctcccttaaaataaagaggctttttagtataagaaataccaaacttggtcaacttcaattgttccttaggatcagtaacggcttgaaattcaaacctaccagtaaataaagaacccggcgttatagcaggtgccataccaaaacctgcaccctttgtatattgagttatcaacttagctgcagtacctttataaccagcttctttttcttccaatgtaccataagacaaattgtacttattagtaaaatcaaaagctttaagatatgcaacaccattattagccgtagccaattcatcaagaggaagaggagaagaccatttcattttatcaggattagttttgtctgcttgttcaccccattcttcaaatgaatatttcaatatattatttttccctacaatagaaactgtatatacctttgtagtcccatcctctgccatcacaatatattccacagatttaccacctgaaaaatcttgtgctataccactgacaggagaaactgtagctttatcagaaacttgaaacgtaggaatcaatgcctttaaatcatcattagttgtagcatcattaactttaaaagctatagttccattttcatcatcaatgacaggttgttctgtaacaaactcactatcaatcacaaaatctgaaatcttcgcttcactgctttcattaccagtcatcttatctccttcaaaagcaacatccactgtttggcccaaagctgcaacagttacaccaattttcatactaacttttccgtctttcactgttccacttactgacgtaggaagtgttcctaacaattgaccaaactctgtagtaaacttcagatctttctgaccactaaaagattgtactccatctttttcttccacagtacaaggcacttcaatatcacctaccaattgacctgcaaatgaaaattttttcaaagacaatatgacttgtgatgtttgatcacctgatttagcaatagatatcacttgagagacaggatcagctgcacttccatcaatggatactaccaaattacctttatagttaccactaatatcagtaacttctgtctgatcatcaccattctttccattatcatcatcgtcactacaagacgtaaacaatgtcgcagtacacaatactgcaaacagataataaaataatttctttttcatttctaaattctctttttaattaataaaagcaaatacgcgatataccatcgcatagaagccaaaatttcacagctgcaaagtaactactatttccacatctccgcaaggtctatttttcttgtttctgttctatttttaaagaaatatactcaaacccccttgtaatgtaccatttttcaagtcaaaattataatataagaaaaaaaagagaatctatttccctaaatctacatatctttgtaataaagtaagaagtacgatatatggaagaattacccaaaatagacttaccagaagaatggcttataggtacaggagttaacaaagaattgctcaatttatatacaaactttccctgtcggttgaaatcggaaatattcgtattatgtatggatggagaaattgaggcttcagtcaatctaaaccgtatcacggtacgggctaacgattttgctactatcatgccgggaagcattcttcaaatacacagtgtaagcggagaacccatactttatttcggaggattctcatcaaaatacatagaacaagccaatttaaccccttcatctatcaatactttatttataacgataggaagacctgtcatttcattaaaaccggaaggaaccaaattattagcggaatactttcaattcttgataaaattatacgcctttttcaatgaatcaacccgtaaaagcattactccgcacctgtacaacaatatacacgcagggatagctgccatgtataacacccaactacaaaacaccaaagaatatttatctaaaggtgaattaatctacaaaaatttcactcaactagtaatgcagaattacaatcatactcgaaatgtagcatggtatgccgagaagcttaagatctcaaatatccatctgtgtacaacagttaagaaagtcacaggaaatacatgtgcagaaatcatttcacacatggtcatcatggatgccaaatcacaattaaagtccacccatctttctatccaagagatttctaattcactcaattttgccaacacatcgttcttcggcaaatacttcaaacgatatgtcggcatgagcccattagcctatagaaataacgggtaaataaaataaatcaaacaccaccttaagtctccggcatcaagaccactcccaacttctttttgccgtccatcttgactaccacaggcttttcaaagcgaacgtgacggagatagttcgtttcctgcactgccggttgcgcattgaggaaatcctgattatatactccatcattcataaaggcgttgatcgtgaaataccctaccccgaaagaagtcagattctggaaaaagtgtgtcccctgactgggatctacccggtaattagtcagaccggcttccacaatcacacgggcagctgaaatatgaggccacttcaccggaataccaagccatgcatcactgctcccccagcgtcccggaccaaccaatatatagttctttccttcgttcaggaactgttgattgatcttttctatctcccaagcaatcgtctgattattggaggcactataattgtccgtttttacataaaccacatcatatacctcattcataatgccgtgtcccaatgaattatacgaacggagaatcacattctcatcaggaatctcgttcaaatcctcgtccagcatttctttgctgtctacgataggacggatctgcaacagatagaaagttccggatttatcatgttcgcgacttaacgttgctgcaaattcaatttcaaccggacggcgcatctcctgttcaccatatttcaatactaactgcagaatacgagctaacgggaaaacatcatgttgcaggatattagcaaaagtaatcaccttacgtcctcccggatataaaccatcacgaatgatctgatcgtacggatcgtaggtagaagcaatataacgcagagcaccgtcactttctgcctctttgacatgaagtttcagcaaattaaaaccatcgtcgatagaaaaatcatgtccagcatttttcaaatccaatgcatagaaacgggtttgagtctccttgagagcaatttccatttcgctggtctgtaacacctgattaggatgataaggagaaaaacgaagggtcataccaccgtcaacaatatatttccctaatcccaaagccagattcaccgttccctcttctgctttttcatctcctaacggataataattgagcgagcgtgccacaccggacatggaaggataataacggtcaccatactgattgccaactacttcctgtaagataacagccattttctcctgatcgattacattcgacgtagcttgcatatacgctttgctgtcacggaaataaaccgaagcatacacccctttgatggcatcggaaagcatccgcaacatttcatagcggtcgtccagataaggaatcatataggtgttgtaaattcctgcaaacggctgataatgtgagtcctccaacaaggaagaagaccgaatggcgatcggagacttcacgacatcgaagaaagtgaaaaagtcctctaccaaccggtccggcaatttagccttcaggaagtatttcaaaatcgtatcatcatccgcatccgacaacgcaatctgatacagattgttggtgtccatgaactcatcaaagacatccgtgcaaagcaccactgttttcggaatagcaatacgcgcattttcaaactcgtcaaactccggatgacgcttcaccatattatcaataaatgccagtccacgcccttttcctccgagagagccatccccgatacgggcaaagttagaataacggtcgaagcgatcgcgcttaaagaccgccacaactccctggttcttcatcttacgatatttcacaatcgcctcaaagatgattttacgatgcgcatccacatcctgaagactattccaggtaatcggtttcaagaactcggctaccgggaacatggcacgtgaataaaaccaacgcgacacgtgattcctgctgatatgatataagaaagattccgcaggtacggcaaaaagaatgttttgcagctccttcaaattccggacgcgggcaatctcctccccggtatccggattgcggaaaataaaatcaccaaaaccaaaattatcggagacgatacggcgcaaatcaacgtccatcttcttggagttcttgtcgataaagctggcaccatacttggctgcataagacgaattttcagattcggaagactgaataatcaaaggaacaaacggatcattcttacgtatctccgcacacagcttgatacctgccagaccgtctttctctccccgttccactttcgggaaacggacgtcagtgattacccccaatatattattctgatacttatgatagatctccatcgcctcctgatacgtacgtgccaacactattttaggacgtccgcgcatacggagcgtacgctggtgtgcattcaaggcttcggtagagaattcctgactctgcttcaacacgaacttatacagattcggcaaaatagaagaatagaaacgaataccatcctccaccaaaagaatcaactgcacaccgacctcctgtacatcgtgttccagattcatcttgtcctctatcaatttgataatagacaccagcaggtcggtattgcctaaccaacagaacacatattcaaacgcactcaaatcttcattgataatccgtttggtaataccatggctaaaaggagtcagtatgacgataggaatatgctcgtatttctctttgatgtgacggccgatatcgaaactgtcattatcccccgtactcggcatacaaatcaccaggtcgaacgacatattttccaactgtgacagtgcttcctcctccgtagatacctgcgagaaacgaggtggatagcgcagagacaaagaagtgtattcattgaaaatcttctcatcaatgcgcccgtcatcctccaacatgaaagcatcgtaaggattagcgattaataacacgttaaaaatccgccttgtcatcaagttagcgaattgtgtatctttgaagtaaagctggtttaatttatatttactaagcataaagtcattctcctttcttatttcaaatcgtctatctgcagaatcacattttgcaaagttaattctttaaatctcattttccaccatcttctttataaagtttacttgtttatctcttattattttgtagatttgtaactttaagtttattcaaaaagactttttattcacatgaaaaaagtaactttattaatgagtggaatcatggtgatgtcatgcgctccccaacagaaaaagctagtctaccccgagacggcgaaggtagacaccgtagacgtgtacttcggtacacaagttcccgacccttatagatggttggaaaatgacaccagtgcagctactactgcctgggtagaagcacaaaacaaagtaacgaatgagtatctaagtcagattccatttcgggaaaacttgttgaaacgattgaccacactggccgattacgagaagatcagtgcgccaatcaagaaacatggcaaatattacttcagtaaaaatgacggcctgcaaaaccagagtgtattctacgtacaggattcactggacggcgagcctcgcgttttcctcgacccgaacaagctctcggacgatggcacagtagcactgaccggtctttatttctcaaacgacggcaaatataccgcttacagtatctcacgcagcggatcggattggtctgaaatatttgtcatggacactgaaagtggcaaactattggaagaccatatcgaatgggccaaatttaccggtgccgcctggcagggagacggattctactacagtgcctacgatgctcccgccaaaggaaaagaattctccaacgtaaacgaaaagcacaaaatctattatcacaaaataggtgaaccgcaatcgaaagataaactgatttatcagaatccggcttatccgaaacgtttctatacagccagcaccagcgaagacgaacgtattctcttcctcacagaatccggtgccggaagaggcaacaacttatttataagggacctgaaaaagccgaattctccttttatccaactgactaccgacctcgactaccaatactacccgattgaagtgatcggcgatcagatgtatatttatactaactatggcgcaccgaaaaaccggatcatggtagccgacatcaaccgtccgaaactggaggactggaaagaactcgttcccgaatcggaagccgttctttcaaacgcagaagtgatcggtggcaaactgttccttacttacgacaaagatgcttcgaaccatgcatacgtttacggcctcgacggcaaacaaattcaggagattcaactgccgtcactcggttccgtaggctttagcggcaacaaagatgataaagaatgtttcttcggatttacttcattcaccattccgggtgccacttacaaatatgatatggaccagaacacctacgaactataccgtgcaccgaaagtacagttcaactcggatgattttgtgacggaacaagtattctttgccagcaaagacggtgtaaaagtcccgatgttccttacctataaaaaagatctgaagaaagacggcaaaaatcctgtattcctctacggatacggtggtttcggcatcagcctcaacccgggtttcagtgcaatgcgcatcccattcctcgaaaatggcggtatctacgcacaagtcaacctgcgtggtggcagcgaatacggtgaagactggcacgtagccggaactaagatgcagaagcagaatgtattcgacgacttcatctctgctgccgaatatcttatcaacgaaaaatatacgaataaagacaaaatcgccattgtaggtggctccaacggtggtctgctggtaggtgcctgcatgacacagcgtccggacctgttccgtgtagcaattccgcaggtaggcgtgatggatatgcttcgctatcataaatttactatcggctggaactgggcaagcgattacggaacaagcgaagacagcaaagaaatgtttgaatacctcaaaggctattctccattgcacaacctgaaaccgggcacgaaatatccggcaacactagtgaccactgccgaccatgacgaccgtgtggttcccgcccattcattcaagtttgccgctacgctgcaagcagacaacgacggtacaaacccgacactgatccgcatcgacagcaaagcaggtcacggtgcaggcaaaccgatggcaaaagtacttgaagaacaggcagacatttacggtttcatcatgtacaatttggacatgaagccggattttaagaagtaaaagtacaaagtattaaattcaggtatcaagtattaagtattagcactgaatacttgatacctaatgctttttctactatcattttatcattatttaatcaaaataacggcataaaatcaatcacatctgaaaaattttcctatatttgcagtgagttagttgacattttatcagaattaaccttttaaaatatagtatcatgaacatccagaaaatcatgtcctctttggaggctaagcatcccggtgaatctgaatatcttcaggcagtgaaggaagttcttctttctatcgaagatatatacaatcaacatcctgaatttgaaaaagctaaaatcatagaaagattggtagaacctgatcgtatcttcactttccgtgtgacgtgggtggatgataaaggtgaggtgcagaccaacctcggttatcgtgtacaattcaataatgcgataggcccatataaaggtggtatccgttttcatgcatccgttaatctttccattttgaagttcctcggtttcgaacaaacattcaagaatgcactgactaccttgcctatgggtggcggtaaaggcggttccgatttctctccacgcggaaagagtgatgctgaaatcatgcgtttctgccaggcatttatgctggagttgtggcgtcatctcggaccggacatggatgtgcctgccggtgacatcggcgtaggaggacgtgaagtgggctatatgttcggcatgtacaagaaactgactcgtgaatttaccggtacattcactggtaaaggattagaattcggcggttcattgattcgtccggaagctactggttttggaggactgtattttgtcaatcagatgcttcaggcaaaagggattgatataaaaggtaagacagtagccatctccggtttcggcaacgttgcctggggagcagctactaaagctaccgaactgggtgcaaaagtgattacgatttccggtccggacggatatatctacgatccggatggtatcagcggcgagaagatagactatatgctcgaacttcgttcttcgggtaacgatattgtggctccttatgctgaacagtatccgaacgcaaccttcgtagaaggaaaacgcccgtgggaagtgaaagcagacatcgcacttccttgcgccacccagaacgaattaaatggagaagatgctcaaaatctcataaaaaatgacgtactttgcgtcggagaaatttccaatatgggatgtacccctgaagctatcgatcttttcattgaacataagacgatgtacgctccgggtaaagcggtcaacgcaggtggtgtagccacttccggcttggaaatgtctcaaaacgcaatgcaccttagctggagtgctgccgaagtggacgaaaaactccatgcaatcatgcacggcatccatgcacaatgcgtgaaatacggcacggaacccgacggatacattaattatgtgaagggtgccaacattgccggatttatgaaagtagctcacgcaatgatggggcaaggcgttatttagaagactttgtttagttgtatttgtatttgtggtttgcgctgctcgtctcctgtgacaggacgcgggtagcgctatttttttgagattaacattattttcgctggaattaattatctttgtagcatgataggttaaataatagtttgtgaatttgttatatgcgataaataactcacaactaataatttaccattattggttttgtaattaataatcaagtaataaataaaaaatgctacaacccgaattgaaatttcgccgtgacaaaattcgcagtctgatggtgtcgcagggcattgacgccgcacttatcacgtgtaatgcaaatttaatttacacgtatggctgtgtagtcagtggctatctttacctcccccttcattcgcctgcactattattttttaaacgtcctaataacatcacaggagagcactcattctctatccgcaaaccggaacaaattgttgatctgctgaaagaacaaggattaccgatgccaaccaaactgatgttagaaggtgacgaacttccttatacggaatattgtcgtctggccggtctcttcccggaagcggaagtggtaaatggtaccccgttgattcgccaggcacgcagcgtgaaaacacctgtagaaattgaaatgttccgccgctccggcattgctcatgcaaaggcttatgagcagattcctggcgtttatcgtcccggtatgacggacattgaattttccatcgaaatagaacgcctgatgcgcctgcaaggttgcctcgggattttccgggtattcggacgcagtatggaaatattcatgggtagcgtactgaccggagataatgccggttacccctctccttatgattttgccttaggcggtcagggacttgatcctgccttgccgggaggagcaaataaaactccgttaaaagagggacaaagcgttatggtggacttaggtggcaacttcaacggttacatgaacgatatgagccgtgtattctccatcggcaaactgcccgaagaagcttacaccgcccatcaggtttgtctggatatccaagaaaaaattgcttccattgccagaccgggtattgcctgtgaagtgctttacgacacagcagtcgaagtggtcaaagcagccggatttgccgacaaatttatgggaacaggacaacaagccaaatttatcggtcacggcatcgggcttgaaattaacgaagccccggtactggctccccgcataaagcaacaattagaaccgggtatggtctttgccctcgaaccgaaaatcgttattccgggtgtaggtcccgtaggtatcgagaactcttgggtagtgaccaacgaaggaatagaaaaactgacgaactgcaatgaagaaatcattgaattaagttaaacagacgatgaaaaagatgtgtccggcaaagaacaggcacatctttttctactaataataacacacttaacccccaaaaccaatgaaacaacctttcattctaacccttgtatcctctgttgcctgcgctgcaacagccgccaacaaagcaccggaaaacaccacaccgacaaagtcaaaaacacccaacgttgtatttatctacgccgacgatctcggctacggcgatctggaatgttacggagctaaaaacgtacagacacccaacgtcaaccgactggcaaaatcgggaatccttttcaccaatgctcatgcaacagccgccaccagcaccccttcccgctactccatgctaaccggagaatacgcatggcgcaaagaaggaacggatgtagcggcaggaaatgccggaatgattatccgtcccgaacaatacaccatggcagatatgttcaaaagtgtcggttacaccactgccgcagtaggcaaatggcatctgggactcggagatcaaaccgccactcaagactggaatgctccgttaccgtgcgcactgggcgatttaggtttcgactatcattacattatggcagccacagccgaccgtgtaccctgtgtatacatcgaaaacgggaaagtagccaactatgatccgagtgctcccatcgaagtcagttatcaaaagaacttcgagggtgaacctaccggaaaaagtaatcctgaattactttataacctcaagccaagtcacggtcacgacatgtcgatcgttaatggaatttcacgcatcggttttatgaaaggcggtggaaaggcactctggaaagacgaaaacattgctgattcacttaccacacacgccattcaattcatcgaggaaaaccaaaacaaacctttctttctctactttgccaccaatgacgtacatgtgccccgctttcctcacgaccgtttcagaggaaaaaatccgatgggattaagaggcgatgctatcgtacagttcgattattgtgtcggtgaaatcctgaatacactcgaaaaactgggattaagagaaaatacactcattattctttcaagtgacaacggcccggtagtagacgacggatacgatgacaaagcagaagaactactcaacggtcatagtcctgcgggaccactacggggcaacaaatatagtgcctttgaaggaggaacccgtattcctgccatcgtcagctggcctgcaggagtaaaaaaaggaatgacttcagacttattggtttcacaagtggactggctcgcctctctcgcttccctgaccggagctacgatgcctaagaataccgcaccggatagttacaactatctgggaagttggctgggtaaagaaaagacagaccgcccgtgggtaatagagcaggcttctaatcacacgctttctgtccgcaccaaagactggaaatacatcgaaccgaatgacggaccgaaaatgattcaatggggaccgaagatagaaaccggaaactctaaagaaccccagctttataagatgaaagaagtgaaagaggtaaccaactatgcaaagaatatgccggagaaagtggcagaactgcaaagtatccttcaaagcgtacgcgaaggaaaggacttaatcgggaaataattccagatatgaaacactgaaacgcttttattttaatgacaacaatatcatgaattatcaatcaatcccgttgataggcagtgccctgctcctatctaccctatctgccaacggacagaaaaaaaatacccagcccaatatcctcttcatcctttgtgacgatatgggatatggagacttaggatgctacggtcaaccatttatccgtacccctcatatagacgccatggccggtgaaggaatgcgttttacgcaagcatacgcaggaagtcccgtcagcgccccttccagagcttcattcatgacaggacaacattcaggccattgtgaagtacgaggtaacaaggagtactggaaaaatgcaccgatcgtggaatatggacagaataaagaatactcaatagtggggcaacacccttatgatcccgaccacgtaatcctgccggagataatgaaagataacggctataccacaggtatgttcggtaaatgggccggaggttacgaaggttcctgttccactcccgacaaacgggggatagacgaatactacggttatatctgtcagtttcaggctcatctttattatcccaatttcctgaaccgttatagtaaagcgttgggtgacaccggagtggtacgtgtagtgatggatgaaaacatccaatatccgatgtatggtcccgactacctgaaacgtccgcaatattcggccgacatgattcaccagaaagcattggagtggctggatcagcaagacggcaaacaaccgtttttcggcgtattgacttacaccttacctcatgcggaactcgttcagccggaagattctatcctgaatgaatacaaagctaaattcaacccggataaagaatttaagggaagcgaaggctcacgatacaacgccatcacgcatacacacgcccaatttgccggaatgattacccgcctggactattacgtgggcgaagttttgaaaaaactgaaagaaaaaggactggacgaaaacacattggttattttctccagtgacaacggccctcacgaggaaggcggagctgatcctactttcttcggcagagacggaaaactacgcggactgaaacgtcaatgtcacgaaggaggaatacgtattccatttatcgcccgttggccgggacacatacctgcaggcgaagtaaacgatcacatctgtgcattttatgatttaatgccgacgttctgcgaagttattggtatcaaagactacgaaaagaaataccgcaataaggaaaaagaagtcgattatttcgatgggatttctttcgcccccacactcctgggtaataaaaagcaaaagaaacatgactttctgtattgggagtttgatgaaacagaccagattgccgtacgcatggatgattggaaaatggtagtgaaaaaaggaacaccgttcctctataatctaaaaacagatattcatgaggatcatgacataacactccaacatccagatatcgtggaaaagatgaaggctatcatctttgaacaacatactccgaatcctcatttttcggtgacgttgcccaaacggtaaacacacagataaagaaataatgagtaatcagcagttggaaagcaagttatcattcattcctatacggttttcaccacagaggatacggagggtacagaggtgaatcttgttcatgccggtactgaaatgaactaatttcgagcttgtgcagatttatttttgatacctaatgggggtatggctaatgatacatgaatttattcgtctgacagctgtttctttttcgtctgacaattgtcagacgaaagaacaacaattgtcagacgaataaatctatgtatgatgaatattaaatcatcgcatattaccaattaaatcttagaagaactaagattagttcattcctgccttgttttactccaattcaactactgattcgcataaatcagtgtctgaatactataggattacgatgcctgattttatatctgttccgtccttctatcagcgaataggcgtcattcccatcttctttgcccgttccagcatgaaagcatgagccgcctcatattcattcggaatcactccatccaagattgcatctttgatagcactcttcaagactccgacctcacgacaaggttccaagccgaaaatctccataatttcttctccgctcacaggtggctggaaattacggacacggtctttctcttccaaatccttcagtttctgtcgaaccaactggaagttattcaggaaacgctgtttacgttccatattcttggaagtaatatccgcttcacaaagcatcatcaagtcgtcaatgtcatcacccgcttcgaagagcagacggcgtacagccgagtctgtcaccacatcatctgcgataacgatcgggcgcatgtgcaggctgaccagcttttgtacatacttcatcttctcattcatcggcaacttcatcttgcggaagatatgcggaatcatcttttcaccgataaagttatgattatggaacgtccatcccgctttaggctcccaacgtttcgtggcaggtttggcaatgtcgtgcaacaaagcagcccaacgcagccaaaggttatcagtcttcttgctgatattatccagcacttccaacgtatgataaaaattatccttatgggaacgtccgttccgtgtttccacaccctgcaaggcggcaaattccggaaaaatcaacgacagcaaaccgctacgctccaaatcaataaatccttttgaggggattggagaaagaataatcttattcaattcgtccgcaatacgttcacgggatataatttcaatccgttccttattccggcaaagcgattcgaaagtatcatcgtcaatgtaaaaacccaattgcgtagcaaaacggatgcaacgcatcatgcgcaagggatcatcgctgaaagtaatatccgggtcgaggggagtgcggattgtcttttccttcatatcctccaaacctccaaacggatctaccaattcaccaaaacgtgctttattgagacatacggccagagcattgatcgtgaaatcgcgacgattctgatcgtcttccagcgtgccgtcttcaacaataggtttacgcgaatcccgttgataagattctttacgtgcaccaacaaactctacttccgtgcctctatattttacttgtgctgttccgaaattcttgaaaacagaaacatgagcaccacgtcccaactgttttccaagggcttccgccattgcaattccacttcctacaactactacatctatatctttagagggacgttgcagaaaaatatcacgaacataaccacctaccacataacactccataccgagtgtatcagccgtttcggctatctgtccgaagatgggttcgctaaaatgctgcttcaattcctcttgagtcaactctatcattctttttagttataagttttgaggggacaaaattacaaaaataagggatatatttgtatttttgccgctaataaaaccagtaaatagaatttgtgatgaaaaaactgattatcctcttttgtggtacgctggcattagctgcctgcggaaatggccttgagaaaaaagccaatgaaaaactgatggttgccaaggctgcctacgaacgtggcgactatgaagaagctaagttacaaattgacagtatcaagattctctatcccaaagcgttcgaagcacgtaaggcgggacaggcactgatgctcgatgttgaaacaaaagcacaacaaaaaacgcttgcttacctggatagcgcctttcaggcaaagacagaagaattcaatgccatcaaggacaaattcaaactagaaaaagatgccgaatatcaacaagtcggcaactacctctggcctacacagaccattgaaaaaaatatgcaccgttcgtacctccgcttccaagtgaacgagcaaggtataatgagtatgacttccatctactgtggtgccggcaatattcaccatacaaaagtgaaagtgattgctcctgacggtagttttgcagaaactccaagctccaaagacagctacgagacaacggacatgaacgagaaaatagaaaaagctgactacaaactaggggaagacggaaatgtgatcgaattcctgaatctcaataaagacaaaaatatccgtgtggaatatataggcgaccgcacctataaaacgacaatgagtccaaccgaccgccaggccgcagcaggtgtttacgaattagcacaaatcctctcggccatggaacagattaaaaaagaacaagaggaagccaacctgaaaatcggattcatcaataagaagaaagaacggaaagcacaggaagaaattaccgattagtaaaaggaaagccatccaccagaaaaagccattggttaataataaaatagacgggaatagttgttatttttcataaacgacaactattcccgtcaaatgcataatgagactcttaatcctctgcgtgagagaaaaggcgtttcctggtagggagaaaaggcgtagtctgccatcatcaaacggcgtagcctgataaccaaaaacggcgtggtctacacgcctttattttatccttctattcaactgattattagccttttcctgctttgattttccgacccgttttccggtcgtcttctttttaccgactgcagactttgtctttccggcaaaaggattgttactttttttgattaacatagacagcacttatataaacagtacttatttcttataattcttattctccttcgtaatactcacccaaaaaccagcgagccacaaaatcccagttttcctgcaataactcctttccgttctcaaacgggaactgtgcttccggcaacaaatcgtgttccattccatatttcagcagatcgaacggacacaaaccttcttcacaaaacagctcgtatgcttcctcttcagccagttcggcattgtagagcggattacgtttgtctgcaaaatattcggctacatcaggaccgatcaacaaccctttcggattggcaaaaaccacaaagttaccgaactcctttaagtcaggcaacaaagaatcctcttcatcttcccacttcaacgactgcacaaagaaaaattttagcgcttcgtaagagtcaaagtataaaagcggttcacctttgctcgcttcaaggaaacgttctacgttcgtaggcatcttttctcccggcaaagctaccggcagaggcatccgcttcttttgcatcagctccgtttccatcagccagtccgttgccagataatcgctgataggagccaattcgaacgcagcatccaaacggttgtaaagcgtatccgcaaactccagcaaatccgcatccatcgggttctctactccatcaaaatcatcgccaaccggagaattgatggcccacaaaaggaaaacaatatcttcacggttaatttcgtccggcaaatattcctccgtcagtgcgtaaaaaggcaaataacgtccgtagcttttccggtgccaatgaataaactgacgccaatttcctccgtctgctacgcaatcttccaaatacaaggcacacgtcaaagccactcgcttctggtcttcctcccactctctcccaccgtatataaaagaatctgccaccaacggcaatagctggttagcgaaatccagataccattcatccgtatccactgcttttgcacgaccatgagcgtccagccatgctttcatatatatcttctgttgcttcatactacaaacgtttcaaagccagtttgataaccttttctaccggagcatccggctcctccttcaagatagccaacaccaccttctgtgaaggtgcagcagcaaagcctagcatcgtcaatgcagacaccgcctcttcctgcacttccgcattggcaggttgcaacaacaaacctgcggaagcccctccggcagcagacatacccattgtttttatcttatctttcaggtcgacaatcacgcgttgcgcagtcttcagcccgatgcctttcaccgttttcaacatgttcgcattttcggtgctgattacgttcaccagttcggcaggcgagagagccgaaagaatcatacgagccgtgttccccccgattccggaaacggaaatcaataataggaaaatctcccgttcctgtttctcggcaaatccgtagagcacatacgcatcttcacgaatcgcctcgtaaatatatagcttacaacttttctttccctgaatagccgaataggtattcaaagatatattggcggcatatcccaccccgttacagtcgatcaccgcggttgccggacttagttcggcaagttcgcctctaatatattctatcataacagggacaaagataaaactttctcaccacagattacactgattttcacagattattcttttgtacattagatatgaagaatatgaaaaaaataaaaatattaaagcagatgaaccaaagttagtagtaatttgtttacttttgcaagcaaaagaaagaaatttgttcattaaaaccaagaaaagaatgaaaaaagtaagagctgccatcgttggttatggcaacattggacattatgtacttgaagcgcttcaggcggcacctgatttcgaaatagccggagtcattcgtcgtgcaggagcagagaacaaaccggaagagttagcaaactacgcagtagtgaaggacataaaagagctgggagaagtagacgtagctattctttgcacgccgacccgcagcgtagaaaaatatgcaaaagaatatctggcgatggggattaatacggtagacagtttcgatatccacaccggtatcgtagacctgcgccgtaccttgaatgctaccgccaaagaacataaagccgtatcgatcatctctgccggatgggatccgggaagcgactccatcgtacgcaccatgctggaagcaattgctccgaaaggcatcacctacaccaactttggtcccggtatgagcatgggacacacagtagccgtaaaagccattgacggagtgaaagctgccctttccatgaccattccgaccggcacgggaatccaccgccgcatggtatacatcgaactgaaagacggatataaattcgaagaagtagccgctgccatcaaagcagatccttacttcgtgaacgatgaaacacacgtgaaactcgttccgagtgtagacgccctgctggatatgggtcatggtgtaaatctgactcgcaaaggtgtatccggcaaaacacagaaccagttgttcgaatttaatatgcgtatcaataaccccgcactgaccgcacaagtactggtatgcgtggcacgtgcttccatgaagcaacaaccgggatgctacacgatggtagaagttcccgttatcgaccttctccccggcgaccgcgaagaatggatcggacatttggtataatatattttatacataaaacaaaattaaaatagagaaaggcggtacacctttctctattttttttatctttgtgagcatactacaaaaaacacaattatgagaaaactattcattctctgcgcatttctattacagctcctgtcgcctgtctacccacagcaagccacaacagccaccatagagcccaatctgaaatacggaaaaccctccaaagaagaactgtctctcacctcttatgccccggacaccaccgctacggctatttatctcttccatcagggacaaagtgacttcatctaccatgacggttttcaactaactaccgagcactgggtacgcatcaaaatcctgaaaccacaaggagtgtcatacgccgacgtgtccgttccctactactctcctaccgataaagatgaaggacaggaaagagccagtgagatagaaggctgctcctacaatatggaaaacgggaaatgcataaaaacacccatgaagcgggaatccatctctttcgaacggttcaataacctgtataaaatactaaaattctctttgcctgctgtcaaagagggcactatcatcgaatatcactacaaactctactccgactatttctcacacatcgacaactggatgatgcaggaagaactcccgatgctctacaaccagtataaaatcaccatccctcatgtatttgtctacaacatcgaactccggggaaaggactacatacaagtgaagcaaagagactcctccattcatgccacggaacgtgagggatccagtgcaggcggagtcagcaaagacttcaccgtttcggcacaagaaaccacctttacctcacgcaaccttccggctatccgtcaggacgaatcctactgctggtgtccggaagactataaggtgcaagtgagcttcgatctgcaaggcactcaattcacccccaatgaatacaaaccatacagccagaaatgggaagatgtagacaagcagttgctcaaaccggaaaatacacagttcggcgaacacctctcactcaccaaccctttccgccctgaaaccaaacaagcctacaacagcgaaatgaatttcgaggagaaaatcatctgcgccttccaggtgctcaaaaagaaaatggcctggaacggacggtatcagctctacagcaaagagctcgaaaaagtaatcaagaaaggaagcggcagtaatgccgacctgaatttcatccttatcagcatcctgaaagactttggactggaggcctatccggtggttatgagccgacgttcatcaggtatgctgccgtacaactttccttctctgcaaaaactaaatacgttctttgttgctatccacgatataaacaaacaaaaatatgtatttttagacagttctatggacgtacctgcctttaatatattaccgcttgaattgtctgtaaacaaagcacgcatcctttcccggaaagagaaagaagagaataaatgggtgaatgtgatggctctttccaacaacaaaagtttcatgaaaatcgatgcccgaatagaaggagatcaggtgaaaggacatcgcagcacagttctttacggacaagaagctgtagagtatcaggcaaatgcaaaacataagcaggacagcctcgtctcgaatcccgaaaacaagatcagtagtcagaaagagcaactcactgtcaccaacctgaaagtgaaaaaacaagaaaatgactgggcactgatagaagaagaattcgatttcgtcttgcaagtcaaccggacggacaatcatctttatatcaatccgatgctctttccgcaactaaagagtaatccgtttatccagacggaacgggtgctccccatcgaatttccatatccgtacaagttcacgatgttgtctacgctgactctccccgaaggctacgaagtggaagaactcccccaaccacaagccatccggtcggaaggagacggcctgcaatgcaaatatatgattcagaaacagggaaatacaatcctgctcaattatgtattccacttaaagggatatatattcctttccgaacaatataaacaactacaagaactgtggactaaagtgatcgagaaaaataatgcgctgatcgtactcaagaaaatataaactttacctatctataccgatgatccgttccagctatctcatcctgaagcaaatgacacatcgggcattcagcctgtcctgtgtccttatctgcctaagtctgcacatacagccggcatgtgcacaggatattctcaaggatgccaattccgttatcgttgaagcacgcacagaggttctctgcaaatctatgacccaatccatagaaaaagagagcctgacaatcaccatcctcaaccgtaaggggttggaagctgcacatttcttctgcggatgtgatatgttccgttctttgcagaaattctccggggaaatcatcaatgccgatggacaaagtgtacgtaagataaagaaatctgaactacagaaaagtgaatacagctcctcgcttagcacggatgattatttttatttttacgaatgcaattatccttctctccctttcacggtgaaatacgaatgggaagtgaagtgcaacaacggtctgatcggctatcccccctttataccgctggcagacttcaaccaaggtgtggaaaaagcgacttaccggatcgaactgcccgcaggacaaggatgcagatatcgtgaactgaacacgcaaggaaaaggaatccaggtaaaagaatccaccggagccaacggacagcaagtgattaaagccaccgcctccaaactctctcccatcattaaagaacctttcggaccggattttactgaactgtttccacgtgtctattttgcgccttccgccttcaagtacgacaagtcggaaggcgatatgagcaactggcaaaagtacggagaatggcaataccgattgctcgacgggcgcgacctgctcaccgaacctttccgcgccaaactgcacgaactgacagcccactgcactaccgaccgggacaaggtgaaagcaatctacgattatctggccaaaaccacccgttacgtgagcatccaactaggcatcggaggtttacagcccattgccgccgccgatgtttgccgcacgggattcggcgactgtaaaggattgtccaattacacccgcgccatgctgaaagagttgggaattgcttccacttatacagtcatcagcaccaccaacgagcgtctactaccggacttctccagtgccaaccagatgaatcacgtcatcctgcaagttccacttccccaagatacgctctggctggaatgtacaaatccatcgcttcccttcggctatgtccaccaagacattgcgggacacgacgccttactcatcgaaccgaccggcggccagatgtatcgcctgcccacctatcccgactcgctgaacacacagcacatcgttgccaacatcaccctctcccccacagccgaggcacggatagaggtgaacgaaatctcccggatttttcaatatgagaatgaagcaggcatcgtctatctggagcctaacaaacagaaagaccgcatccgttcaagcatcaacttatcccaagccgatattcagaacctgcaaatcagcgagtgcaaggagcccaatccgtctatcaccttcggctacactgccaccagcaatcaatacgggcataaaacgggcaaccgtctgtttatccccaccaatgtgttccgaaaagaattcagtgttcctcctgtgacgaagcgcacctatcccatttacatcaactacggatacacagataccgacagcatccgcatccaactgccggaaggatatgtaatcgaaggacttccgaaaccgcttgacgtgaaaagcaagttcggcagtttccattccggtattcaggtgaaagataaggaaatctacatcactcaccgattgtttatgcgcaaaggggtttacagtccggatgaatatgcggcattcattgatttccgcaagcaagtggcaggacaatatggaggaaaaatcattttaaaaaaagaataaggagggaaacgctttacagaaaataaagtatctttgcgactcaacattttttgtgacttaaccattcaaaaaaaggaacattgaagaacaaacgatacaatcatatagaagaatgggcaaatacccttagccacggaataggcatcctgcttggaatcgtggccggatatttcctattggaaaaggcttccgagaatatggaaccgcagtgggcagttgcttgtgtatccgtctatctggcggggatgctttcctcttatgtcagttctacgtggtatcatggcagccgtccggggaaactgaaagagttgctccgcaaattcgatcatggagctatctacctgcacatcgcgggcacctacactcctttcacgctacttgtcctgcggcatgccggaggatggggatggggaatcttcgctttcgtctggctgtcggctattgccggtttcattcttagcttcaaaaagctgaaagaacacagtaatctcgaaacggcttgttacgtaggtatgggagcctgtatactggtagccatgaaacctttgttagatcatctggcagagttgggagccactactgctttctggtggctgatcggcggaggagtttcgtatattgtgggagctgtcttttattcattgcgcaaaccgtatatgcatgccactttccacttgttttgtctgggaggcagtatcggacacatcattgcgatctggctgattctgtaaggaatggtagggacaaaaaaaaggctatctatcccagacagccaatctttgttaaccttaaatctaatactatgaaaaacacagtacaaagatacggacttttcgatcatctccaaattttcaggccaaagcagcctaacttataacacggtttaataaaaagcagaggttcgttaacgtttaacgcaacaaagttaaaaattaacgaatcgtttattaactatttaaatgattaaatgatcggaccaagtaaaaattgttgttggcgagttccctgctaaaagatagtgacgctatccgatacaaatagcgacgctatatgacaatgataccgtcactatcccaagcatataccgtcactatcttttctacgtcaatcggagggcttacgtccacttatagcatataccaacaatgattgttgcctgatccgaattatctctaaagcctctctctaaagttgaaacaaacagattcgccaattcgttatatataaaagagtaatttaaaacaattataaagcataaatttatggactgggaaaatcatcttataaagcaccttcaatggtcggactccattatcaaccgggaagccaaagaacacgtagcccgtgaaattgccgccacggcaaaagacggagatatgataggagccggctctggctctacagtctatctaactctgttcgaactggcgcgacggattcgtgaagagcacttgcatattgaagtgattcccgcctctcaagaaatctcgatgacttgcatacagctaggcattccacaaactaccctttggaacaagcgccccgactggacatttgacggagcggacgaagttgacccgcagcgaaacttgattaaaggacgtggcggagctatgttcaaagaaaaactgctcattagaagcagccgcaaaacgttcatcatcatcgaccccagcaagcgcgtcaatcagttgggaaataaatttcccattccggtagaggtctttccggactcactaacttatgtagagcatgagctgcaacgactaggtgcatcagaaatcgtcctgcgtccagcccacggcaaagacgggcctgtctttacagaaaatgggaatttcatcctcgacacccgttttaactatattgattcttcgctcgaagaacaactcaaaaccattaccggtgtcatagagagcggccttttcataggttatgatgtcgaagttatcatggcagagtaaaacaacgtaaactggaaaatcgcattttgtagaaatatgaattaaattgttctagtacaaataaatatagtatagctctgtatctatttcatttagcagaattgagttgtacgacacccgggtgtcgtacaagttattattacagtatcttgcattcttctttactataagtcataactccaatcactgtcagactatagcatttaatttataacccttaaaacacagatattaaaacgtcatcaaacatatttttattcaaagccgaagatagttgaaaaaatagggaaaataccgggaaattcattaaaaattcgggtagaatattaccccccatctcaaaatcaatgagaaaaagagactactaaataaacaagaactgataaaggaagtttcaataaaagaaaccgaaagaaccggccaatttgcgaaaacagaaagaaaacaattgaaaaacaacaagataggagaaaaaagcagaaggaaaggaggaaagaaaaatcaataagtcttagcagaacttggtatgtagaagtttctgcctttatcattgttaatagttctttaacccttttgaaggtgcaaaatgataaaaagataccgttttggaggcaataatattcacttttccttgaaaagcctgattttggtgctatctttatgacagaaatcatcttttaaaagatgctaaatttgaaagaagttgttttaacctatcagtttttagaaacttattgctttcaaaacgatactttttagttaaatacgtaacacttttttcgatttgtcataattcgtgttatctttgcaacctgttagagacaaaaaatctgtttataggttaaatttaagagagaatttatgaaaagaaaattgatgttcttaatgaccttcctttttataggtataggtctagtgacagcgcaaacatccagagttaccggtttggttacctctgaagaagatgggcaacctgtcgtaggtgcttcaatattggtgaatggcactacccttggtactatcactgatattgacggtaagtttacaatcacgaatgtaccaagttctgctaaaactttgcgcgtttcttatgtaggaatgatttcgcaggacgtttccatcaaaccgggagtgataaaagttgttttgaaaagcgacgcgaaagcactggatgaggttgtggtgacagccatgggtatctcacgcgagaaaaaagcactgggttacgccgtccaggacgtaaaatcagatcaactgacgcaagctgccaactctaatctggcgggagcattgcaaggtaaagtgtccggtttggacgtgaagccttcaagtggtatgccgggagcttcttcacagatcaccatccgtggtgcacgttctttctcgggtgacaacactccgctttacgttatcgacggaatgccggtaaccagtacgccggacgttagcacagacattcagaacaatggtagtgtgagcggagccgacttcgccaaccgtgcggtagatatcgaccctaatgatattgaaagtatcaacatcttgaaaggacaggctgcttctgcactttatggtatccgtgcttccaatggtgtgattatcatcacaaccaagagtggtaaaggattggaaaaaggcaaaccacaggttagcttctcttctaatgtcagcttcgatgtagtcggtcgtctgccggaattccagaaaacatacgcacaaggttcgggtggagtattcagcactacttcgggaacgtcttggggacctaagatttccgaacttcccaacgacgcaacgtatggaggtaacacggataacgaatacacgcagaagttcggtaagcaacagggaaaatattatgttccccagcgtgcagcagccggtcttgacccgtgggctactccacaggcgtatgacaatgcaaaagacttcttcgacacaggaatcacctggagcaattcattgaatgtagcgcagatgctcgacaaaagctcctactctatctcattgggaaatacacatcaggacggtattatctcaagcactggtatggacagatataatgtaaaggttagtgctgacacgaaactgactaacaactggagttccggatttacagctaactatatcactacttctatcgacaaggcagtgacttccggtaacggtctgttgagaacggtttacgcagctcctcccagctatgatcttgctggtattccaagtcacgtagacggtaacccgtacacacagaattctttccgtggtagctttgacaacgcttattgggcaatggaaaacaacaaattcacagaagataccaaccgtttcttcggaaatgtatacgcaagctatcagactgattttggtacaaccaaccacaagttgaacgcaaaatacatggtcggcgtggatgcttacaccactcactatgtagacagctacggatacggtagtaacaccggtggcggtcgcggacagattgaaaactacggctggacgaacgctacatacaactctttgctgaccatcaactatgactggcgcatcaacgaggactggggattgaacgctgtattgggtaacgaaattatccaaagtaacagaaagaagtattatgaatatggtacgaactacaacttcccgggatggaaccacatcaacaacgccactactcaacagacagaggaagagacgtggaaaaaccgtacggtgggattcttcggtaacgtatcggcttcttacaaaaatatgctttatctgaccctcaccggacgtcaggactacgtatctaatatgccacgtaacaaccgttcgttcttctatccttctatttcggcaggtttcattctgacggaactggatgcattgaaaaacaatgttatcaatcatgctaaattgagagtatcttatgcggaagtaggacaagcaggggatttcctcgaaaactactactcaactccgacctatggaggtggtttttacacgctgactccgatcatgtatccgatgaaaggtactactgcctatactccgtactacacaattttcgacccgaaactgaaaccgcagaacacacgttcgtatgaagtgggtgctgacgtgaacttcctcgataacttaatcacattcagttatacgtactcacgccagaatgtgaaagaccagatttttgaagtgcctttggcttcttctaccggtgccagcaaactgctcaccaacggtggtaagattcataccaacacgcacgaattcactcttggcttcaaccccatccggacgaaaaatatcaactgggattttgcattcaactggacgaaaatcgataactacgtagatgaactggcaccgggtgtagaaaatatctctctgggtggttatgttactccgcaggtacgtgcttcggcaggtgagaaattccctgtaatctatggtgtaggtttcaagagagatgaaaacggtaatcgtctggtagacgaaaacggtcttcctatcgctggtgaagcacaggtaatcggtaaagtttctccggacttcctgatgggattcaacaccacattacgcttatggaagtgtacaatcagcgcagtactcgactggaaacagggtggtcagatgtacagcagaacaaccggactggcagactactacggtgtcagcaagagaacggaaaaccgcgaaggtaccatcatcttcgacggatacaaaaccgatggaactaaaaatgatatcgctatcacaggtgcaaacgcacaacaggtattttacagccgcctgaacgatattgacgaatcttctgtatatgacaattctttcatcaaactgcgtgaagtggctgtcaactacaaaattcttcaaaaacgttcgatagaactttctgtaaacgcatttgccagaaatatcctgatctgggctcaattgcctgacctcgatccggaagccagtcagggtaacaacaacatggcaggagcatttgaagattattcaatgccgcagacagctagtttcggctttggtttcaacattaaattttaatctgcaagacaatgaaaaaatataaatcaataggaaaattgctggcagtttctttcttgactgctgccattgcttctgcttgtacggaagacgcaatggataaaatcaatgaaaaccctaacaatcctctggatgcgcctgcaaaatttttgattacagacttaggggtaagcactgcattcagcactgtgggaggggatttctcgctctattcttctgtttacattgaacacgaaacgggtatatccaaccagctttaccgggcggaagtacgtagcggagagcctacaacggctactacctacaacaacgcatggatcaacgtgtattcaaatatcaagaacgctaaaatcgttatcaagaagtgtgaagaagatccttcggaaaaaggaaacgtagtgacggaagcaattgctaaaatcctgctcgcttacaacggagcagtggcagccgatgtatttggaaatacaccgtacagccagactggtatcctcaatccggacggcacaccaatgtatatgcagcccaaaatagatacgcaggaaagcatttatcaggaagtgatgcaaaatctggatgatgccatcactctgctggataacggtactgccaaagatgcaggtctgtccggcgcagtcggttctaaagacttgatctacggttcaaacaccagtactcaagcaagtatgtggctcaagacagcttatgcgttaaaagcacgctatacaatgcgtctgctcaataaaagtgccaataagacaactgatcttcagaacattcttacttatgtgagcaaatcatttgctaatgcaagtgaagaatgtaaactagctgtttatgacgctgattcacagttgaatccgctttggtcattcagctatagccgtaacagtttggcagccagtgccagtctgattgaaaagtttgttgagcgcaatgaccccagagcaccgcaagcatttctggagcccgatcccaccggctatattgcttatggatacggaggtacgcaagctacagacatcgcaggtatcaaagcggctcctaacggaactccgcaagagttgcagaacaattatggtatgtcaatgatatcatgggcaatgtcggctcctactcttttaatcagttatcacgaagtgaaattcctcgaagcagaagcattatgccgtttgggaggcagactgggtgaagctaagagtgctttaaaagctgcaatcactgccggattcgagaatctggaaaactcaattatagatgccgctgacacttgggtatatgatggtgacagcgatttgggggcagatgtagcagaagcctatttcacggatgaagtagaaccgttattcgatgccaaccctctgcaagagacaatgatacagaagtatctcgccttcttcggcgcatccggcgaatcactagaagcctacaatgactaccgtcgtttgaaaggtgcaggagaaaacttcattgtactgaagaacccgctgaacagcagtaaattcccattacgcttcggttatggagcagacgatgtattggcaaatccagaagtgaaagctgctttcggtgatggacagtacgtatatagcgaggccgtatggtgggctggcggaaacaaataatgaactcaaaatctctcaaaggagagactttacatagagtcgtttctgtactctaacaaattaacagagacgaacaaaaataggccaaccgtgaggttcgcctattttattttatccaaatgcattagatgaagttagagcaataccatttttctacccaatcatacttcttttccatgcttttacgtttttaacgcttaagcactttttggataaattaaaaaaaatctcgtaagaatcaatcttaccactgcaaatcgggtaaatatttactcaacgtggtgcggagaatacccaaggtgataggtttcaccaatacttcagttgctcctgcattcattgcattttccttatccgagctaaaagcataagccgtctgcatgataataggaatttctgtgttagattcacgaattatcttcgttgcttccaatccgttcatcaccggcatcttaatatccatcagcattgctttggctctttgctggtgttgctgaaacaactccaccatttcctgaccatttttagcccactcgatatcacactttttgcctatgatagccttgattaatttaaagttgctgtcatcgtcttcagctactaaaattaagggtctgaattcattcatttgttcgctttccatatcgcttatttattgttttttatctgttttttgggattaatctcccttttcagcccgcaaggtataaaaaagattcatatatttcgctatctttgcgcctcaatttaaaagaatagtatgatttctgttgacggactagccgtagagtttggcggcactgctttatttagtgatatttctttcgtaattaatgaaaaagaccgcatcgctctgatgggcaaaaatggggcgggaaaaagtacgctgctgaaaattttggcaggcgcacgacaaccgacacgtggaaaagtttccgcgcccaaagattgcgtagtggcctatctgcctcaacatctgatgacggaagacggaagaacagtgtttgacgaaacggcacaggctttttcacatctacatgagatggaagcgcagattgaaaaactgaataaagagctcgagacacggacggactacgagagcgacagttacatggcgctgattgaagaagtgtctgccttgagtgagaagttttattcgattgacgcaactaattatgaagaggatgtggaaaaggcattgctcggattaggattcacccgaagcgattttcaacgccagacgagtgattttagcggtggatggcggatgcgcatcgagctcgctaagttgctgttacagaaaccggacgtactcttgctcgatgagccgacgaatcatctggatattgaatctattcaatggttggaagatttccttattaataacgggaaagcagttatcgtaatcagccacgaccgcaaattcgtggataatattacaacacgtaccatcgaagtgacgatgggacgtatttatgattataaggtgaattattcccaatatctgcaactgcgtaaggatcgccgcgaacagcagcagaaggcatacgacgagcagcagaagtttattgctgaaacgaaggagttcatcgaacgattcaaaggaacatattcaaagacgttgcaggtacaaagtcgcgtcaaaatgctggaaaagctggaattgctcgaagtcgatgaggaggatacttctgcattgcgactgaaattcccgccttccccccgttcgggcagttatccggttatcatggagggtgttggaaagacatacggagagaaagaggtgttccgcaacgccaatctgacgattgagcgtggtgataaagtagcttttgtcggtaaaaacggtgaaggtaaatctacactcgtgaaatgtatcatgaaagagattgagcacgatggtacactgactctcggacataatgtacaaatcggatacttcgctcaaaatcaggcttcgttgatggatgaaaacctgacggttttccaaacgattgacgatgtagccaagggggatatccgaaacaagattcgtgatttactgggtgctttcatgtttggtggtcccgaggaatcgatgaagaaggtgaaagtactttcgggtggggagcgtacccgccttgccatgattaaattgctgttggaacctgtcaacctcctgatcctggatgagccgacgaatcatctggacatgaaaacgaaagatatcctgaaacaggcattgctggattttgacggcacactgattgttgtttcacacgaccgtgacttcctcgacggactggtgagcaaggtgtatgagttcggtaatcaaaaggtgacggaacatctttgcggcatctacgagttcctcgaaaagaaaaaaatggattcgttgcaagaactggaaaagaaataataaataataaaaagagggtatcggctgcaggcggaataaaagtatttgtatatttgcaacatcatttataacaggcagttagaaaaaaatggatgaaacaaggcagttatacattataagcggatgtaacggagctggtaaaacaacagcttcctacactgtactgcctgaaattttattatgtaaagagttcgttaatgcggatgaaatcgccaaaggtttatcaccgttcaatccggaaagtatggctatagaagccggccgtctgatgttgaaacgtattaatgaactattagctgctaaagtaagtttctctattgaaacaacattggcaacccgttcatacacccggctcattcaaagagcacaaaatgctggatataaagtcagcttgatttatttctggctgaattctccggaacttgccgtcaaccgtgtgttacaacgggtcaatgaagggggacataatgtaccgatagacgttatctaccgccgatatcaggcgggcattaacaatctgtttcagatttatatgccgcgtgtagactattggctgttagccgataatagtatttctcctcgagtaattgtagccgaaggttaccaacatggcgaggatcgaatatatgaacttgaactttttaaatgcatcaagaattatgtcaaataatgaaatgcaagaattgagcgataaattacgacgcggccttcagctggcagaaaaacgattgctggaaaaaaatgctcgcaatggtaaactccttagtcagggaacgccagatggaaaagtaatttatgtatcagcaacagaattgctggaacgtttgcaagaaaaagaaaaggaatcaataaaaaaataaattctctaaaagaaaggatgaaagggaagaaacgaattatagtaactctgctgttttttatcaacattattatgttggtggcagcggttattccccatcatcatcaccccaacggaatgatttgcatgaagcaggacttgcctgtagaacagcaatgtcccacgcatcatcatcacccgggaaacgactcatgttgcagcagtgaatgtatgactcgtttctactctcccactccatccatacatacggatagcggaccggattacgtattcatcgctaccttattcacggatgtaatcatcgagcatttattacgaccgcaagagaaacggattaaaaactattacgtttaccgagactctctgcatggtacggatactcatcgtaccacttctcttcgtgcccctccctactctgtttttgcgtaaaagcgtaaatgcaaattagttgcatctgcgctaccttatctttgtagcgtaaaaagaaaacagtaaaatttagtaggaaaatatcattatgaaaaaacttattttcgtgggaatcctgggcttattcgtgctgggatcctgtaataatagtaccgtcacacacacacacgatgaacacgatcatgccgcggaaggacataatcacgaggcagaaggacccgatcattcccatgaaggcgaatgtagcggagaacacaatcatgaagcagccgatgaatacaacgaagctgccgaagcccacagtgatgaaatcattcttccgaaagcgaaagctgaagcagccggtgtaaaggtgagcgttattgaacctgcacctttccagcaagtgattaaaaccagcggacaggtgctggctgctcaaggggatgaatcggttgccgtagctacagtagccggcgtggtatctttccgtggaaaagtaacagaaggtatgagcgtcggcagcggcactccgctagtcactatttcttcaaagaatatcgccgatggtgatccggtgcaacgtgcccgcattgcctacgaggtatccaagaaggaatacgaacgtatgaaggagcttgttaaaaacaaaatcgtatccgacaaggattttgcacaagcggagcaaagttacgaaaacgcccgtcttagttacgaagctctttccaagaatcattcggctatcggccaaagcattacggctcctattgccggatatgtgaaaagtattctcgtgaaagaaggtgactatgtgacaatcggacaaccgctggtaagcgtgacgcagaaccgtcgtcttttcctccgtgccgaagtgtcggaaaagtattacccgtatctccgcaccatcagttccgccaatttccagactccttataataatcaggtgtacgagttgaaagcattgaacggtaaacttctctctttcggaaaagctgccggagacaattctttttatgtgcctgtcacttttgagttcgacaacaaaggggaagtgattcccggctcatttgtggaggtattcctgctttcttcagcaatggaaaacgtgatttctcttccgcgcaccgcgctgacagaggaacaaggcatattcttcatatatctgcaactggacgaagagggttataaaaaacaggaagtaacgataggagccgacaacggcaaaagcgttcaaatcctaactggtgtaaaggctggcgaccgtgtagtgaccgagggtgcttatcaggttcgactggcaagcgcaagcaatgcaatcccggcacacagccacgaacactaaagagactaggcgtcgcaaccgtttttttttgtgcggcgcatctatcaagttatttataactctcaattaatgaaatatcatgcttaataaaattatacattactccctacacaaccggctggtggtagtttgtgcggccatcctcctgcttattgcgggaacgtataccgccatgcatacggaagtagacgtattccccgacctaaatgcacctacggtagtaatcatgaccgaagcgaacggtatggctgcggaagaagttgaacaactcgttacttttcctgttgaaactgccgtaaacggagctacgggtgtgcgccgtgtccgctcttcctctactaacggattttccgttgtttgggtagaatttgattggggaacggatatttatctcgctcgtcagattgttagtgagaaattagcggtggtcagcgaatcgctgccggtcaatgtcggcaaaccgactcttggaccacagtcttctatcttaggcgaaatgctcatcatcggtctgactgccgactccacttccatgctcgatcttcgcacgattgcggactggaccatccgtccacgcctgctgtctaccggaggagtggcacaagtggctgtgctcggaggagatatcaaagaatatcagattcagctagatcccgaacggatgcgtcattacggcatctcgatgggagaagtgatggctgtaacacaggatatgaacctaaatgccaatggaggtgtgctctatgaattcggaaatgaatatattgtacgtggtgtactctccacttcgaaaacagagcaacttggcaaagcggtagtaaagacagtgaataacttccctgtcacgctggaagatattgcaaacgtaaccatcggcccgaaggctccgaaactgggtactgcttcagaacgcggcaaatctgccgtcctgatgactgttaccaagcaaccggctaccagcacactggaactgacggacaaactggaagcatctctgaaagacctccagaaaaatctgccgccggacgtaaaagtttcaacggacatattccgtcaaagccgctttatcgaaagctccatcggcaatgtgaagaaatcactctttgaaggaggtattttcgttgtcatcgtgcttttcctgttcctggcaaatgtacgtactacgctgatctcattggtgacactgcctctttccctgctcgtttcgatcctgactttacactacatggggctgacaatcaacaccatgagtcttggaggtatggcgatagctatcggctcattggtagacgacgccattgtcgatgtggaaaacgtatataaacgactgcgggagaaccgcctgaaagtggaagcagaaagactaagtacgctcgaagtggtattcaatgcgtcgaaagaggtgcgcatgcctatccttaattcaacgttgattatcgtagtcagctttgttccgttatttttcttgagcggcatggaaggcagaatgttggttccactaggtgttgcttttatcgtggccctgtttgcgtctacgatagttgccctgacactaactccggtactctgctcttatctattaggaagcaataagacgaacaaggaactgaaagaagctcctgttgcccgctggatgaaagggatttatgaaaaagcactgacttgggtactggcacataaacgtgtgactctcggaagtacaatcggactttttgtagttgccctcggagtgtttttcacacttggacgcagcttccttccttcgttcaatgaaggatcgtttactatcaatatcagttctctgccaggtatttcgctggaagaaagcaacaaaatgggacatcgtgccgaagagttattgatgacaattcccgaaatacaaacggtagcccggaaaacgggacgtgccgaattggatgaacatgcgttaggagtcaatgtttctgaaatagaagctccgttcgaattgaaagaccgctcgcgcagtgaactggtagctgatgtacgtgaaaaattaggtacgatcaccggagcaaacatagaaatcggacaaccgatcagccaccgtatcgacgcaatgctatcgggtacgaaagcgaatattgctatcaaattattcggtgatgacctgaataaaatgttttcactcggtaatcaaatcaaaggagcgatcagtgacattcccggtgttgccgacctgaacgtggaacaacagattgaacgtccgcagctgaaaatacagcctaaacgggaaatgctggctaagttcggtattaccctgccggaattttcggaatatgtgaatgtagctttggctggaaaagtgatctcacaagtgtatgaacagggcaagagttttgacctgatcgtaaaagtgaaggatgatgcccgggatgaaatagagaaaatccgtaacctgatggtagacacgaacgacggccgcaaagttcctttgagctatgtagcggaagtggtatcggccatgggtccgaatacgatcaaccgcgagaatgtgaaacgtaaaattgtcatttccgccaatgtggccgatcgtgacttgcgcagtgttgtgaatgatattcagaaacgtatcgacacatcggtacaattacccgaaggttatcatatcgagtatggtggacagtttgaaagcgagcaggctgccagccggacattagcgttgacttcatttatcagtatcgtggttatcttcctgttgctgtacaatgagttccgcagtgtgaaagaatccggggttatcttgctgaatcttccgctggcactgatcggtggtgtatttgctttggtgattacaacaggagaagtcagtattccggctatcatcggtttcatttccttgttcggtattgcaacgcgtaacggtatgttactcatcagtcactacaatcatttgcaaaaggaagaaggtttgaatgtatatgatagtgtgattcaaggttctctcgaccgcctgaatccgattttaatgacggcattgtcttctgcactggcactgattccattggcacttgccggcgacttgcccggtaacgaaattcaaagtccgatggcaaaagtgattctaggaggattattaacgtctacttttttgaacggttttatcgttccgattgtttatctgatgatgcatcggaaaaaggcccagaaaagcctgtagagagggatatttttcctcggtgagaaaaccatcgttccccggtgaggaaacaagtgtttctcggtgaggaacgggtcgttcctcggtgtcaaacaaatagatgccttatcataaagtatctatcaacaatagcttgtaataaataaagaaattagaaatgaaacaaatcatgaccataagcgctgcacttcttttcttaaccataggtgaagtgcaagcccaaaacggaattgaacaggtattgaagaatatcgaaacgaacaataaggagttgcaggcaaacgagcaactgattacctcgcagaagctggaagccaaaacggataataacttgcctgaccctactctctcttacgcgcatctatggggagcaaaagataaaagcgaaacaatcggtgagctggttgtttcacaaagctttgatttccctagtttatacgccacacgtaacaagttaaaccgtctgaaagccggaactcttgacagtcagtcggatgtttttcgtcaggagaaactgttacaggcaaaagaactttgcctggacattatcatgcttcgtcagcaaaagcatattttggaggaacgtctccgcaatgcggaagaacttgctaaaatgtacgccaagcgtctccaaacaggggatgcaaatgctctcgaaaccaataaaatcaacttggaactgttgaatgtcaaaacggaagcgtctctgaacgaaacggcacttcgcaataagcagcaggaactgaatacgctgaatggtaatattccagtggttttcgaagaaaatcaatatccgactataccgttcccaagcgattaccaaatgttgaaatcagaagtcatggctacagaccgtaccttaatggcactaggcaacgagagcctcgttgcccataaacagattgctgtcaataaatcccaatggctgccaaagctagaactcggctaccgtcggaatacagagactggtgtgcctttcaacggtgtagtggtgggcttttccttcccgcttttcgaaaatcggaataaggtgaaaattgctaaagcgcaggcactcaacatcgacttgcaaaaggataatgctacactacaagtggaatctgaattggcacaactttaccgggaagcgaaaacgctgcatgcttcaatggaagaatatagcaagactttccagtctcaacaagatttggcattgctgaaacaagctttgacaggtggacaaattagtatgatcgagtacttcgttgaagtatcggtgatctatcaaagtcatcaaaattatctgcaattggaaaatcagtaccaaaaggcaatggcacggatttacaaaagcaagctataaatagtacataaaaaccctttaggtatgggttacgctgaacatactaatttctatttttaagttatataagtatatttatataataaattaggcacggattacacagaattcacggtctttagtattgtcataactataaagcaacagtgttaatccgtgtaattcgtgcctaaatatatctcctctctttttcttcaaattccgactggatatttcaaaacaatacattacatttgcaacgaacataaaatctgaattatgagacctaaacatttctatttattcatgttatgctgcatccttacgctactaagtggctgtaaagatgatgacgacaatccactgcgtttttacaacagtgaatacgaagtacctatgggtggcagacgttacctcggcctggaaagcggaaatggtgactactcacttgcagtgaaagacacacgcatcgcaagtgccggaactgaaactggctggagtggagtacctgccggacgtatgatttatgtaaccggtatcctcaccggaacgacttatctgacagtaacagacaacgccacacaagaaacctgcactttaccaatcaaggtggtcgataattacgaaaatatggagttgctacgcagctacttgtctaacttacccaacggagatgcgaatcttctacccggtatttccgacatttttctgattaacaaccacgcacgggatgcttattttttcaaacaaggagaacagaccgccttttcatccggacttgaattaataacccaaggaagttacaaactggaaaaagaagaaggagacgataagaaaatgacactaaccctcactttttcggaagatatggcaacacctgtttccgatcataaattcataatatggggaaactcgtacttatttcatcggttggataaaagcctaaatctgaactggaacactccgcctattggagaaacgcggacatcacctgcacctcctccttcctacacgctggaagaaatagctgaaggcacagaaatcggaaaaggcagacagcttagctttagtctttcccaacaggaaatacctgcgggaatactgccttaatcagtaacgtattctgataagatgcgtatattttccggtaagtatccactacggatgcgccattcttgcggataaagattattggcacgattgccgatgttcttcacaaatccgagaggaatatgccgataagtaagcaaaacatatccacgaggggctgttaccggtaaggtaatggcctcttttcgtaaatatgtgatggcctgttcataacttatttcttccgtagcgaatgcttcccggcataaaagtgaggtacacattgccaacgcatggttagggatcaaatcctttcctttcacctcgcctatctcaatccctgccgacacaattttcaggctttgtttcatcgtcgccaattcattagtatagtactgtgagaaagctcggatatttgttccttccgccaataaaatatacttgtccgaattttcatcattcaaccaacttttagccatattcagatattctttcgatacaggagaagatgctgctgttcctttcttatccttcttcttgaaagctttctctttggcggaagaagatactgggatctcttcttccgtctccggcttacgaaaagccaccagaaaaaagccttcacctttcgtcttatgagggaaaaaatgatagacgggaatagaagatttagaatgatcccctttatctgacaaaagatctcctgttatattccaattctcctgcacctgcacagttaatggttcgcccccatactcttgttgaatccaacgtgcattctcttcatcctcttttgtattaaatgtacacgtactatatataagaatacctccgggcttcaacgcatcccagatatctgcaataatccgtcgctggcgctgccaacagatttccacattctcggggctccactcttccacagctaccgggtctttacggaacataccttcaccggaacagggaacatctgtaagaatcacatcaaagaaagagagtaaagccgaaaaatctgccggatcattattggtcactaccacatccggatgtccccacttcgtcaggttttcagcaagaatctgcgaacgattccggattacctcattggctaccaacaggctcccttcgggaagtacactacgggcatgagtcgattttccaccgggagccgcacaaagatccaacatcttcaccggtcccgtgatatattgccggagtacctgctccacaaacatggaagaagcttcctgaacataataacagcctgcatggaataagggatcgaacgtgaaagtgagacgctcctccaaatagaatccttcggaagaccaaggtactttatccgataaagaatgattgattttcaattgattcaaccggatgctaaccggtggttcctgttggagggcaacagccagtttgtcgtattcttcatcgcccaatagagcgcgggtgtagtctataaaagaagcaggtaattccatctttcgtttattaatttccgcaaatatcaaaaatatttcgtctctttgcaactttctatgatattaactacgtctaacagataaagaaataaattaaaaaactattgatatgaaaaattttctattagcattgatggttgtactgaccacttgcacactggctgttgcccagaccaccgttgttcgtgattccatcgggaaagtaaaagtaactgtgaccaaagacaataaagcaaatacgaacaatactgctgtcacagtgattggtgtagacacagcagatgctgattctgcagacgtaaatgcaaactcaagtaatgttagcaccactcatggcaaagccagcttcacattcgattcggatgacagcgatttccccttccacaatgttagtgccggcggaggtattctggtagcaatcattgcaatcattgctgtattcggatttccggtattcattctatttgtaatcttcttcttccgttataaaaaccggaaagcacgttatcgccttgccgaacaggcacttgctgccggccaaccgcttccggcagagtttatccgcgaaaacaaaacagtcgattcgcgttcacaaggcatcaagaacacctttacgggtatcggtcttttcatcttcctctgggcaatcaccggcgaattcggaattggagctatcggcttactcgttacattcatgggtatcggacaatggattatcggtagcaaacaacagactcaagacacaaatgctacccggatgcatacgggtaataaggatgaaaaaaagaacccgaataacgttagaaccgatagtttcgaaatcatcccttccgaatccgaagagaaagacaaaggagtaaacgaagaaaagaacgacgagaataaatgagccaactcaatgatatatcgttagtcgcacaggtcgtggtgttcaagaacaccagggcctttgaccagttggtgaaggagtatcagtcgcccatccgacgattcttcctgaacctgacttgcggcgacagcgaattgagtgacgaccttgcgcaagatacatttattaaagcgtatacgaacattgcctctttccggaacttgtcaagtttctctacgtggctgtatcgtattgcttataatgttttttatgattatattcgcagccggaaagagacagccgacttggatacaagagaaatagacgccatcaacagcaccgaacaggagaatatcgggcaaaaaatggatgtctaccagtcgctcaaaatgcttaaagaagtggaaagaacctgcatcacgttgttctacatggaggacattagtatcgacaaaattgcagggattgtaggagtaccgtcagggacagtgaaaagccatctgtcacgcgggaaagaaaaattagcaacgtatttaaaacaaaacggttatgacagaaatagacaatgataagctcttgcgcgatttcttcgcagaaaacaagcaggaaatagcagataacggattcagtcgccgtgtcatgcaccacttacccgatcgtagtaatcgcctggctcgtatctggagcgctttcgtgatgactgtggcggccgcactttttgtatggttaggtggattggaagcaacttggggaaccataagagaagtatttatcggtatgattaatcatggcacttcaagccttgatccgaagtcaattattatcgcagctgttgtactattattcatggctacacgaaaggttgcttcgatggcataattaactcctggaaagaagttatttcgttaaagaatgataaatttgcccttgttagcaaaggagcccaaacttagatatcgtatctttgttcttctgtaaactaaaagagtgagaagagttttgaaattacgtatatttattttatttctgttcctgcctatattgagtgttcaggcaggtatcatcgacagtctgatgatacatcccagggactcaatcggattaaccagcgattcccttgtgctacgctatttacaagaatcgggaatccctatatctgataataataaggtaaaactgctaaaaagcggacgggagaagtttatcgatttgtttgaagccatccgggaagctaaacaccacgtccatctggaatatttcaacttccgaaatgactccatcgccaatgctttatttgctctgctggccgaaaaagtgaaagaaggggtcgaagtacgagctatgttcgatgcattcggaaactggtcgaacaataaaccgcttaaaaagagacatctcaaaaaaatacgtgaacaaggaatcgaaatcgtaaagtttgacccgttcaccttcccttatatcaatcacgccgctcaccgggatcatcgtaaaatagctgttatcgatggaaaagtagcatatacaggcggaatgaatatcgcggattattatatcaacggactacccaaaatcggaacctggcgtgatatgcacatgcgtatcgaaggagatgccgtcaatgatttgcaggagattttcctgactatctggaacaaagagactaaacagaatataggaggagaagcttattttcctcaacatcaggaacagacagacagcacgaatatcgttgtagcaattgtagaccgtaccccgaaaaagaatagccgtatgttgagtcatgcctatgccatgagcatttactcggcacaaaagaatgttcatattgttaatccttattttgtaccgacctcttccatcaaaaaggcattgaaccgtacaatcgaccggggagtagatgtaacaatcatggtttcctccgcttccgatattccgtttactccggatgctgcactttacaagttacataaactaatgaaaagaggagctactgtctatatgtacaacggaggattccaccattcaaaaataatgatggtagacgatttgttctgtacagtcggtactgctaacctgaacagccgcagtctacgatatgactacgaaaccaacgctttcatttttgataaaaaaacaaccggtgaattgaataatatgtttcgaaatgatatcgagcattgcacccaactgacaccggaattttggaaaaagcgttctccatggaagaagttcgtcggctggtttgctaatttattcactccatttttgtaattttgtacggaaaatcattttcaccacagattatgcaacttattcattatgaaacaatatctggatttactcaatcgtgtacttaccgaaggcacgaaaaaagatgatcgtaccggaaccggaacaatcagtatcttcggtcatcaaatgcgttttaaccttgatgaaggcttcccgtgcctgacaaccaaaaaactgcatctgaaatcaatcatatacgaattgctttggtttctgcagggagatacaaatgtgaaataccttcaggaacatggagtacgtatttggaacgaatgggcggatgaaaatggtgacctggggcatatctatggctaccaatggcgttcatggcctgactataacggtggatttatcgaccagatcagtgaagtggtggaaacaatcaaacataatccggattcacgccgtatcattgtaagtgcttggaatgtagcagatttgaataatatgaatttgcctccctgccatgctttttttcagttttatgtagcagacggacgattgagtctgcaactgtatcaacgcagtgctgatatttttcttggtgttccttttaatattgcttcatacgcattattgctgcaaatgatggcacaagtgacgggattgaaagccggagattttgtccacacctttggtgatgcgcatatctacctgaaccatctggaacaagtgaagctccaattatcacgcgaacctcgcccattgccacaaatgagaatcaatccggacgtgaaaagcatcttcgattttaaatttgaggacttcgagttagtaaactatgatccgcatccgcatattgcaggagcagtagccgtgtaaaaaagatgagtaaagtatcaatcattgctgccgtagaccgccacatggctataggcttcgaaaataaacttcttttctggttaccaaatgatttgaaacgtttcaaagcattaactaccggaaacactatacttatgggacgcaaaactttcgagtcattaccgaaaggcgcattgcccaatcgcagaaatatcgttttatcttccaatccggatacagtatgtcccggtgcggaagtttttccttcactcgaagcagctttgaaaagctgtcgggaggatgaacacatctatattataggaggggcaagcatttatcagcaggctctttctttagctgacgaactttgcctgacagagataaacagtacggctcccgaagcggacgcctattttccggaagtatcccaggagctgtggcaagagaaaagcagagaagctcatcttgcggatgagaaacatctctgctcttatgcttttgttgattacgtgagaaaataagaaaatcgattcttatcgcacctcaaccacgaatactgactaatgattaatcttcatcttctatgtcgaccataatcggcatctgccgcttaatggcttcatggaaggagattaatgtctcggtacgcgccaaacccaatggttgcaacttatcgtgaataatactcaataagtgatggttgttctttgcgtaaattttaataaacatatcgtattttccagtagtgaaatggcattccaccacttcgggaatagcttccaaagcttttgttaccgaatcaaaggattcggggtcttttagatatataccaatataagcgcaagtctcatatccgattttctcggggtcgatgacatactccgaaccttttaatattcctagattagtaagcttctgaatacgctgatggatcgcagcgccggaaacattacatgctcttgccacttccaaaaaaggaatacgcgcattccctgcaatcagtttcagaatttgctcatctaaagcatctaattgatgatgtcccatttttgaatcaaattgtttttatcaatgaatcttttatgcaaagttagcgatttttcgacaacaaatactataatctattacttttatttgcagaaagcggataagtcaacaatagttcgtacctttgcgaaaaacataaatatactatttatatgaaacatatttgctgtatcattctgtgtttctgtacttctataggaagtttcgcacagaattttgctgattattttcagaacaaaacattgcgagtggattatatctttaccggggatgctacacaacaggctatttatctggatgagctatcacaacttcctacctgggcaggacgtcaacatcatctttcggaacttccattggaaggcaacggacaaattatagtgaaagaccttgccagcaaacagtgtatctacaaaacgtcattctcttctttgtttcaagagtggctgtccacagacgaagctaaagaaacagccaaaggatttgagaatactttccttcttccttatcctaaacagcctgtggaggtagaagtcactttatattctccgcgaaaaaaaagattggctacctataaacatatcgtgcgtccggatgatatattgattcataaacggggggtatcacatgtcactccgcatcggtatatgcttcaaagtggtaacgaaaaagactgcatagatgttgccatccttgcagaaggatacacagaaaaagaaatggatattttctaccaggatgcccaacgtacctgcgaaagtttgttttcgtatgagccgttccgctccatgaagggtaaatttaatattgttgccgtagccagtccttctacggacagtggtgtcagtgttccccgcaaaaatcagtggaaacaaacggcggttcactcccatttcgatactttttactcggaccgttatctgactaccagccgggtaaagtctatccataatgcattggcaggcatcccctacgaacatatcattatcctggctaacacggatgtatatggtggtggaggaatatacaattcgtatacgctgaccacggcccatcacccgatgttcaagccggtagtcgtgcacgagttcggacacagtttcggtggactggccgacgaatatttctatgatgatgatgtgatgacagatacttatccgctggatgtcgaaccgtgggaacaaaatatttcaacacgggtgaacttcgcttccaaatggaaagatatgcttccgtcaggtaccccgatcccgacccctattgctgaaaaaaagaaatatcccgtaggagtatatgaaggaggtggctactctgccaaaggcatttatcgtccggcttatgactgtcgcatgaaaacaaacgaatatccggagttttgtccggtttgtcaacgtgccatccgtcgaatgattgaattttatgttccttaatggaatacaattatattattgtcaaacttaaaacccaaacctcatgattagacttcaaccaattagtacgtcggatctgcaacattacaaattcatggaagagcttctaattgattcgtttccaccggaagagtaccgtcagttggaacaactgcgcgagtacactgatcgtacgggcaactttcataataacatcatctttgatgatgacctgccagtcggcttcattacctattgggattttgacagtttctactatgtagaacactttgcaaccaatcctgccctgcgaaatggaggctatggaaaacgcacgctggaatacttatgcaattatttgaaacgcccgatcgtattggaagtagaacgtccgatagaggaaatggcaaaacgacgtatcagcttttatcaacgtcaaggctttacgctgtgggaaaaagactatagccaacctccttacaagcccggagatgattttctgcccatgtatttaatggtacacggagaattggattgtgaaaaggattttgaaacaatcaaaaagagaatacataaagaagtatatggagtaaaagaggctcagttgtaattcttggggggtggattaacatttgttaatttctctttatgcagcgttttgagtgtgctacgccttcccctgtcccactactaggcccggcatttacagatttcggtttcgttaaaatcatatttttttaccccatgttcatccgttacttcttaggtaacggacaacacacatatagaatacacatcgctgtgaaaaaaggaaaaaaatcgattatgagggaatataaaagcgggcacctaacattcaatataaagcattcttgaatttaggtaataaaaagcctttgagcatgaagatgttatccttcatgttcagatagattcatgttgcatattttagagaaaaaggaaaaaaagaagtttattgtttgtttgctattaatatttttacctatctttgtagcgaatataactccgttacctaagaagtaacaccagcattaagtccctaatccataatgctttaataatataaatcagagcattttaaaattgcaaacgtaagaataattcaatttatttacttttgttctttcttccaattcaaaaccctttaaatatatctgtgttgttttaatagatttgtgtcctagtgattcgctaatcatttcgataggtacacctctgtacttagcagtcgtagcccaagaatgacgaagcgtatacgacgtgacgggcgaatgtagccttaattttctggacaggcttttcaactcattattaaaacgtctcaaagctgactgatactcacgataggctccttcttcattccgcttgtacgctccgcttaatatccggaaaagataatctggatagccggaactccgggcgtcagatttattatacaatcccccaattgcattctgcgctgactccagcacttctatactcataggagtaccggtcttggtacgattgtacttcaaaagcccccgctccagattagacttttccaaatgggctaaatcagaaaaaggcattccacaaaactgaaataacagattggcaatggcctgcgtccgacgaagcttttccgattgaggatctttgtttaatagcatgtgaagttcgccgatcgggatagctttcttctgacgtgtgtccaccccggtaaaaacatcccggaacaaaccatgtacataaggagcctgatgcatatcgacaccacgattgtagatactacgcaacatacgcatatacgtagaaatcgtattgggcttcaaacgggaagccatcagatagttgctatacctctttagagtttcacggtttatcttactaaacgtgatggattgagttccacaaaactgcgaaaaagaacgaatagcgtgtttatacacatgggccgtagaataacgaccctcttgtcgcaaacaatcgatgtaattgtttgcacaaatagtaaatcgatttttttccataaattataacttatctcatacgtgttattaaaaacgtgcggaatatagtaagattatagataaaatgaaccacaattttaaatttacttactgttttagatagaatttcgaattatttctaaaaaaaataagtgaagccatgcagtattttcaataaccgtgcatttaacttataaaagaggaaaaaaagagaaatcaaaccatatatcattaaaacctacaacctgagcttaacaagtgaagtggggaaaaataaaaaaaagagagagagttttttatacaacgtccccaaaaacgaggaatccctgccaattttcgagttggcagggatttattttttatcttcaagaagatgatctttttacttgcagtatttggttatcaattcatctgcgttcggatcacccaattctttcgctttcttaaagttgccgcaagcttcatccgtcttcttcagctgtatctggcaaagtcccaataaacggtaagcctcaccatatttgggatcagtcttcaatatattattcaaaatcagaatagcttcttcataccgtcctacacggaggtttataactgcatgctctgcctgataggtgaggtctgtcggattcatctcgatggccttggcaatatcgtctaaagcgcgttgaaactgacgggctttcaaagctgcctgttcgcgataataatagaacacgtcgttcacttctcccttgactgccgtatggtaagcatcataatcgagcattgcatttcgtgcctggtcggcattcatattcatctgcgcacgttccaacaagtatggagcaaagtcggctgtaatcggttgcgggcaacgggcaatacagctatccattaaggccaccacttctttcggatcccctttcagcagttccttcgttttggcagcactaaagaaagtggccggagaagcaatattgctggcatttaccttttcataagcagccaaagcaccggcatagtcttgttgggcaaacagtatatcgccttccatttgagtgtaaattggcagcggatcaatagcaattgcctgacggacattcttcaaagcggtgtcatacgtccagtctttgtaagttttctccggcttcgataattgataagcatacattagcttacctatattataatatacatcatctttcttctgggctactttcagagcttgattaaagtcggcaacggctttatcataccaagtctggtcgtctttacctttagatgcataataattggcacgacggagataaccatctgcattggcagggaactggcggatgaagtcatccaacagcttttcatagtcctcgcccgaaaggctcgaagaggccatgaacagatatactaatgcctgatcttccgtttcgggtaaacctttccggataccaatgcttttcaaggcagcgtctcccaaagaaagagcactgattttctgcgacatggcaaaagctgctcccgccgcataacaagtagtcaccgtatcgataccggatgatttctgcgcaataccaaatacctgaccttccgcattcatcaccggacagctcaccatcttatctttcatatgcatgctcaatgtataataatggtattctccggctactttggaaacatctttcaccttaccattaacacaagcaatgcttttctgcgtagaataaggaagcatccatgcttcggctcctgccaccggggctgttttggcaacaatcagcgcaggcactttcttctcggtgatagccacacggaacttaatgacatcatacatatcattcgctccaagtatcaggctgaccggcatctgcttgccttcggaagtaatcactaccgcacgttcagctcctttaaaaagagtataatctgataaagccaatccgtcttcggacacaaagaatccgtttcccgtattcagcattttatcattcttgtcataagtcactattgagaagactgcacgttttgccttctctacccattttggggtttgtgccatgcttccttgtaccaggaagaaaagcagcaaaggtagaattaaaatcttcttcatatcagtcattgtttctttgtttcacagcttcgtaaatcaagataccggcagctacagagacattcaaggattcgatagtgcccagcatcggaattttcacccattcatcacagagggcaaggttttcataagaaactcctgtatcctccgctcccattatgatgcagaggggacctgtataatcggccttggtatagtcataatctcctttttcggtagcagccacaatgcggaaaccactgtctttcagatattgcagagtcgaacgaaggttctgttcacggcataccggaagagtatgtagtgctcctgccgatgttttcacggcatcagcattgaccgacgcactaccccggacaggaataatcacagcatcgacagctgcacattcgcaggtacgtgcaatcgccccgaaattgcgtacatcagtcactccgtcgagcataacaaaaaacggattttttccttgctcaaacaagaaaggaacaagatcttccgctttctgataagtcacagaagaaatgaaggcgatcactccctgatgatttttccgggtaatacggttgatacgctctaccggaacacgctgaacaggtatcagcgtacctttcaaagctgcaaaaagctccttggaaagatcactttgaatatctttcttcacgaggatcttatctatctcttttccagcctgaagggcttctatcacggcacgaacgccgaaaatcatttcacttttatctaacatctggttgattttctattttactatttactattcactatttatcagttgcgggcaagcagggatttggcattgctaagggcagcttcggtgagagtggcgccactaagcatgtgagctatttcctctactcgttcttcgtcagtgagacggcggatatggctgttggtttccgtatcgctatctttcttgtataccttataatgagcacgcccacgggcagcaatctgcggcaggtgggtgatactgattacctgacggttacagtcgcccatttcctgcatcatgtccgccatacggtcggctatttcaccggagactccggtatctatttcatcaaatacgatagtcggcagcttgacggctccggcaatcattgccttgatagaaagcatgacacgggcaatttcgcctcctgaagctacggaagagatattctgcaaggtgccgttcttattggcggaaaacaggaagttgactgtatcttctccttgcaatcccggttctttcttcagtcccatttctatctggaaacgaacattcggcattcctaatggaatcaaccgggcagccagctgtttttctacttcacgagcagctttcgtacgggctttggtcagcacttctgcctgttgtttcacttgtttatattgttcctctttgcgagcagtcagttcggcgatacgctcatcataggaagtgatgtccgacaatttgctgcggtattcatccgttagcgctatcaattcggcaagggtttgtgcccgatgtttctgctgtaaggaataaatcagattcaaccgttcattcacttcgtccagacggaccggattgaattcaacggagtcactttgtaaggagacttcgtgcgaaatatctttcagttcgatataagcgctctccatacgttcggtaagttccttggccggctgatatactctttgtagattattcagtgtattcagactgtctttcagataagaaagcaatccgccttcatccgaagcaaacgactgttccacccggtaaagtccggcttttatctcttctgcatgacttaatgtttcagcttcctgctccagttcttcttgttcgccctccaccaaacgggcttcttcgagctgttcgagttggaagcgaatataatcttcatcggagcggcttttctctgccagcaacactaattcagcgagttcgcgatcagtctgtttccattcgtcataacacagatggtatttctccaatgcagcatcattatgtgccagaatatcaagtacattcaactgaaatccttctttattaagcagcagattctgatgttgcgaatgtacatctatcaactgttcgcccagctctttcacttgtgccagcgaagcaggagtatcgttgatgaatgccctgctcttaccggaagactgcacttcacgacgcaaaatgcactcttcatcatattccagctcattttcttcgaaaaacgggcgcataccataagcagatatatcaaaacgtgcctctattatacacttggaagctccgtggcgaatcgctttcacatcggcacgctgtcctagcaggagcccgatagctcccagaataattgattttccggctcccgtttcacctgttataacggaaaagcctgtttcaaaactgatatccagtttttctatcaatgcgtaattctgaatgtatagtgaacgtaacaccttctattttaattaaagattaaaaattaaaaaccgggagacagggtggctaccagacggtcgatgatgtcttgagctacttccgtcttcggcttcagaggatagtctgtacgacctttcctgtcgatgatacttattttattggtatcatggcggaaaccggctccagcatcattcaacgagttgagcacgataaagtcgaagtttttgcgttcgagctttccttcggcattctgctgctcattattggtttcgagggcaaagccaaccaataactgatttttccctttcagtgctcctaaattggcagcgatgtcttgtgttgcctgaagatggagggttagttcctcttctttctcccgctttatcttcttgtcggccactgtttccggacgataatcggctactgccgcgcaaagaatacctgcatcagcatctggaaaatagatctgtgcagccgcatacatttcttctgctgattccacatctacacgccggatacgggaatgtttcgttttgagctgcacaggacctgttatcaatgtcacctgtgctccacgacgggcacattcttctgccaatgcgaatcccatctttccggaagaataattgcctatgaaacgcaccgggtcaatcttttcgtaagtcggtccggctgtaatcatcactttctttccggatagttcgtcactcgaagcgaagaattcatccaatacccggatgatgttttccggctcttccatacgtccctttcctaccaagtggctggctaattctcctgttcccggctcgataatgtgattaccgtagaaacgcagtatatccagatttttctgggtggcgggatgggcaaacatatcgaggtccattgccggagcaacaaacacgggagcttttgccgaaagataagttgttatgagcatattgtcggctattccattggccattttgccgatagtagaggcagtggcaggcgcaatcagtacagcatccgcccacaatccgagatcgacgtggctattccacgttccgtcacgctgggcaaaaaactcactgatgaccggtttgctggtcaaagccgaaagagtgatgggagtaataaattcttttcccgccggagtaattacgacttgcacttccgctccctgttttatcagtccgcgaatgatatagcacgccttatacgcggcaatactgccggtaattccaagaattattttttttccttttagcattattttgtaatcaaattactcatttcacgcaaacggatttttgtcaatgccgccttagtgttcaacgtgaaatcactattcaaaatccaactgtaatatccgggatctttcttcaaaacctcggctacagacattcctttatattttccgaagttgaacacttccaccccattatcatcgtacaccatgcgtccggcaaagtctacattcttgctgaaacttgaataatctgccaggaacgcaatatcattctgaagatcggagtaacggtcgagctgtgctttcagcacttcgtaagtggcccgtgtatctgcttcggcagtgtgtgcatcttccagattcttgtcgcaatagaatttataggcagcagacagggtgcgttgttccattttgtggaagatcacctgtacgtctacaaatttgcgtttcgtcatatcaatgtccactccggcgcgaaggaactcttcagcaaggacaggaatatcaaaacgattggaattaaatcctgccaaatcgcaaccttcaatgtccctggctatgtttttcgccacttctttgaaagtagggcaatcgactacgtcggcatcataaatgccatgtatagcagaagatgcttccgggatatgcatttcaggattgatacgtaatgtttttgcttcttcatttccattcggatatactttcagatagcagatttcaacaattcggtctgtgttgatattggttccggttgtttctaaatcaaaaaaaacaatgggatttttcaggtttaatttcatttctaattattttttccaccacagagtaacacagagttctacagagcaataaatacataaaacactctgtggaactctgtgttattttgcggtgattactattaatcatttagcatcatcggcatcagcagcatcagcaggtcttcgttttcttcctgctctaccgggatgattactccggcacgtgaaggatctgcgagttcgatgactacttcgtctgctgaaatattgttcaggatatcgatgaggaatgtcgatttgaaaccgatgctcattgctgcacctgcatactggcaaacttgtgtttcttcggcagaagtagaaaagtcaatatcttgtgcggaaatcacaatctggttttcctgcatacggagtttaatcaaactacttgcctgcgacgagaaaatagacacacgacgcaaagctcctaccaactgttgacggtctacggtcactttgtgcgggttgttctgcggaattaccgagttgtagttcgggtaacgtccttcaatcaggcggcaaaccatccggtagctttcaagcatgaatacagcattgcgttcatcgaattcgatcgtcactgtgccttgttctttcggcaaaagattcttaagcaaggtagccggtttcttcggaaggataaaggctgcacgctcgttacctttggctgccaatgtcttgcaacgcaccagtttatgaccgtctgaagcaaccattgtgatatcttctgtggtaatatcgaaataaataccgttcatcaccggacgaagttcgtcatcggcagtagcaaataccgaacggttgatacctcccagaagtacacttgcctccatttctacacggactgcattatcacccagtgtagccgattgcgggaattcatccgcattctgccccatcaggctgtattttccgttctggtactgcactgttatttcataattatccggattgatttcaaatgtaagtggttgttccgggatttctttcagtgcatcaagcaatgttttcgctactacggcaaaacgcccgtttgtatcgctttcattcacttctacggtagtcaccatcgttgtttcactgtcggatacagtcacagacaatgttccgtcttccaattcgaagaggaaacaatcgagaattggcagcgcattttttgaattaatcacacggctgatggcctgtaaatggctggaaagagcagtacttgaaacgataaatttcatatattttcgtgtatttaagttttaaatgttctatcgcacaaagttacgaaaaaagatttgggctgcccaataaaacaaaagaaaaaaacaggcattgtgtgagggatattactaaaaaattgtaacttcgccccagaatttaaaattatcgcaatggaatttacaggaaaaatcatcgctatcctccagcccaaaggaggagtttcaaaagctaccggcaacgagtggaaagcgcaagagtttgttatcgaaagtcacgaccaatatccacgcaaaatgtgcttcgaagtatttggggcagataaaatagatcagttcaacattcaaatgggcgaagaactgactgtttcattcgacatcgattctaaccaatggcaagaccgctggttcaacagaatccgtgcatggaaagtagaacgtgtcagcgtaggtgccccaatggctacaggcggttccgttcctcccgcagctccgtcggcaatgccggaatttactccgggcgacgcaaaagacgatctgccattctaaaccgaaagtcattcgtcggacgaataagcataaaaaactcccgatagaatttaattctgtcgggagttttttttatagaatgattgtatataaaccacgttttttattctgatttatatttcaaaacaatattgggatatactactccatcggtacaggcaaactggacaaagagtgtaaaattacggaaaaagtctgcattgcgcaggaagaaatccggtacgaaacggacgtgattttccgattgccggaacacgtgatcgaaatccgccatcagcataaaatgatatgaatcagacaggtgatccatacccgtctgataagccattgccccattaagcacttcccctttatccagttggcgaatataatgcgacaggctatcctcatccggagcgagtaacaaacgtccgccataaaatgctgcatacacatccaaagtcagttcaacaaaactggtcagttgtttaaacaatgttgtttgaggcaaccgatagaccaagtatgccttatttacagtataacaaaaagtaatacggggagtttttcttccttcatctgccggagcagtattgacaaaggcacgaagcatcctttcagcttccgtcacatctgccacagacaggctcaagactgccgctgcatcctgcaacgtatcttcacgctggaagagacagacaaccaggtcttgcccggcattttccatcagatagcgggaaaattccttatctctattctgcacttcactcgtgcggactgccccgttctgctcctgcgcatttccataagaaagcaaagacgcccagtccgtaatcccctgtctgctaaaatagaaagcagtggagggtagtgcttcacccgggaagcctttgactgattgctgctggcgaagttggtttataaatgcaaagcaagtgtctgcatcatgtgtgatgccggagaaatagataaaatcatctttcatcttcatgtcaaattccgtccatcccatcatccctttcattcgggcatagattgtggcggccgctacactttttttcggagcacgcactcctgtaaaggtcggatcatccgccaatgatttgtcactcttatatgcatcaataacgttttcaatcagttttttctgaaaacttaacgccataaaatcagacgtcagatagcaggctagaaaatcaccatctgccatcgggtaaatgattatttcctctcctttgtaaacaaacgttttcggtggataaagcgaagatatatatttacgcacaaacctgtttaccaattccttatctccatttcccaatctgcaataaagtacctggttccgttcgttatccggttcgtggaaactaatcagcatctgattcatttgccgactcaagccatggggagtatcttccgagagggcataaaggctttgtttcagataagaaaaaagtttggatacataaagatattgctgatttttactacaagtcagatcatcgacctccgctacaaactcgagcacatcatcggtaacaaatacggctgaagtggtggatggaaccagttcataaagatcaaaatctttctgcccttcggccgccgacagtctaaaaaaagagtacaatgcgaaacctgagcacaaaagtacaacagaagacgtgatcgctattttcactatcgtacgaagtttcataatattcgctgtttatcggctaggtgcaaaaataataatttctacaaagaaaacaaaacttttgctaaaaatttcaccgataatcaaagatagatatccaatccgtcgaatgccaggtgaatattttccggaaggctcttttcaacctccgcatgcaagcccatatcatgactcatgtgtataaagtacgtcttctttgcctgaatgcgctgcgccactgccaatgcttcttccaaattctgatgagtaggatgcgtggcaatccgaagtgcattcactaccaaaacatctattcccgccaattgttcataggattcttcgggcatggtcagcatatcagtgatataacctaattgcccgatacgatatcccagaataggcaatcgaccatgcatcacacgtaaaggaagcacctccgtgtggttaactgaaaaagcctgtcccaccgagatttcctgcaaaggaatgtcgggaactcccggataacgatggtcaacaaaacaatagggcatacgcaagcgcaagccttgtgccacataattttccgcataaataggcactgaaccaaaccggcaaaacggacgcaaatcgtccaacccacccacatggtcataatgttcatgcgtaatgagcacaccatctatcttctcaaaaggaagacgcaatacctgtgtccggaaatccggaccgcaatctatcaaaattcgcgcatcatctgtctcaacaatagcagatgcacgcaatcggttatctttcggatcggtagaagtacaaaccggacatgtacagccgatttggggtactcccgtcgatgttccacttccaatgattcttactttcacttgttacttctcaatttattaagttaacttccgggtggatatcaatgccgaacttctcatgaacagaggctcggactgcatctgaaagcgcaagaatatcgctaccttttgctccaccaagattcactaacaccagcgcttgtttatcatgtacggcagccggacctaaggccttacctttccagccgcattggtcgatcatccatcctgccggaattttcacccgatcttctgccagctcatagtaaggtatccggggatattcctgctgcagggcttccagtttttctttcggcacaatgggattcataaagaagctgccggcatttcccattaccttcgggtcgggcaacttgctctcacgaatatcaattatcactttccgtacaacagaaagcgtcaatgccggatatttttcaagctcctgacgaatggttccataatctaacgtataatgttcttttttactaagtcggaaacggacataggtgacaaaagccgacttgttttccgggcgtttaaagatactgttgcggtaggtatatccacactcttccaccgaataaacgcgttcttcagcttgaatgttcaccgtttccacagctgttatcagatctttcacttcaacgccataagctccgatgttctgtaccgcgctcgctccgacctcaccggggatgagcgacaggttctccgttccataccatccatgttctacgcaatatgcaacgaagtcatcccatactactcccgctcccactcgtaccgacacagagtgttcatcttcctccgtcacttcgattccttcaatgcgggaatggagtatcaacccgtcgtaatctttggtaaacagcaggttactgccgccaccaatatgcaaaaaaggtgtcacaatggcaccttgcacaatcagcttcttcagttcttcaaccgaagaatattctaaaaaacgagcggcactgacatcgatgccgaatgtattgtagggcaaaagagaatacatatatttttagttataagttatactgttatagtgcgtcgtaacctgtatcagatacttgtatcttcaaacttatacaattcccattctccggctttccggcggaaataaaggatattggaaaaaccatttccgatacctttcaacgccaggattttcgtgggcgaatcatcgtcattccgctgtccgtaattaatattagaaaggcggtcgacaggaagtaccggtttgaaggcaaaccactgattaagatcgagggttgtctccaaaatggagaaatcatcgtccggatcactggttacaaaagccaacggctcccgcacacgctgactctgaaaaagactatccgttgcaaaatgtccgaaaaactcaacaaagttttcattatcactttgttcaatgggccgcaggttgattgcctccagtatccatgcacctttgatacgttcaaaatagtatcttttcaccattcgtgttttcacgaacatccactctacctgcacagaagtgagggaggtatctcctactagatccatgtcttcttctctatcaaacagcagtgtataataatgctgcttggtaaacaagtcgtcatgcttccagttgcgttcctcgatgtttgacttcttatctccattgtagtagggcaatggaaatttcacacgctgacgctgtaacacatcatcggaagcaaaattgtaaataaaatcatcgaaagattcatccgcctgtataggctgcggatcttccggcgatttatcatggtggctagaatcggctatctgccggactgaatccacctctttagtaatagatgcgaaggggtcaatatttgttttcttgtttccacaagagctcaatataccgagcagtatgacccctgcaattagttttttcattatttcagtttctctcttaacttttcaagcatatccaccgtcatgctttccaaattgtaggccggcttccatccccactcttcacgagcacaggtatcatccagactatcgggccagctatcggctatgcgctgcttcaaaggatctatatcataaatcatctcaaactgcggcacatgcttcttgatagcttgatatatcgtttccggatcgaaactcatggaagcgatattgaaagcattgcggtgtatcaatcttgccggatcggcttccatcagtgtgattgctgcattcagcgcatccggcatgtacatcatatccattaaagtgccttgcttaatggggcacacaaacttttctcctttcactgccgagtagtaaatatcgacagcataatcggtcgtacctcctcccggaggggtcacattcgaaataatgcccggaaaacggacagcacgggtatcgacaccgtatttattaaaatagtaatcactcaataactctgtcgttactttagtgactccatacatggtacggggacgttgaatggtgtcctgcggtgttttcgtgtgaggcgtactagcgccaaacgaaccgattgaactcggagtaaacactgcgcacccttgttcacgtgccacttccagcacattccacaatccatcgatgcctattttccaggccagcttgggtttcgactcggcaactacggacaacagagcagccaaattataaatcgtatcgatgtgatactcttttactacagatgtgatcgcttctccgtccgttacatcagcaatagccgacggtccggactcctttaattcccctttaggttctgcacccggaatataacctgctactacatttgcatttccgtaacgtttccgtagctccatcgtcagctccgaccctatctgtccggtagctccaataatcaaaatgtgttccattttttcttctgacttagaatatcaagcttaaatagtgcgcaaagtaagcacttttttttcagattttaatcaaaaagacattgttattccaagaaaaattgtgtcctttgcaatataacttaatcacccaaacactatgtacggtaaaatgcaagaatatctccgccaaacattggctgaaattaaggaagccggactttataaagaagaacgactgattgaaagtgcgcagcaagctgccatcactgtaaaaggtaaggaagtattaaacttctgcgcaaacaactatctaggattgtccaatcatccccgattaatcaaggcttcgcaggaaatgatgaacaaccgtggatacggaatgtcatccgtccgtttcatttgtggaacacaagatatacacaaagaactggaagctgccgtctcggactatttccagactgaagacacgattctgtatgctgcctgctttgacgctaacggcggtgtattcgaaccgcttttctctgaagaggatgccattatctcggactcgctaaaccatgcttctatcattgacggggtacgtctttgcaaagcaaaacgttaccgttatgccaatgctgacatgaaagacttggaaagatgtctgcaagaagcgcaggcacaacgtttccgtattgttgttacggacggtgtgttctcaatggatggcaacgtagctccgatggatcagatttgtgatcttgccgagaaatacgatgcgttggtaatggtggatgaatcccactctgccggtgtggtaggtgccactggtcatggcgtaagcgagttgtataagactcacggacgtgtagatatttataccggaacgttgggtaaggctttcggcggtgcactgggaggatttaccaccggtcgtaaagagattatcgatttgctccgtcaacgtagtcgcccgtatttgttctccaactcattggctccgggtatcatcggtgcaagtcttgaagttttcaagatgctgaaagagagcaatgcactgcatgacaagttggttgaaaatgtaaactacttccgcgataagatgacggctgccggatttgatattaaaccgacacaaagtgctatctgtgctgttatgctgtatgatgcgaagttatcccagatttacgctgcacgcatgcaggaagaaggaatctatgtgacaggtttctactatccggtagtgccgaaagatcaggcccgcatccgtgtacagatttctgcaggacacgaaaaagcacatcttgacaagtgtatcgctgcctttatcaaggtaggtaaagagctcaacgtattgaaagcggaataactccgaagcaaggtttccttgcggaatctatattttaggcgcagattacacggattacacggatcacacagatttcacgtatcttacacagttgctttataacaagcttcattctagaaaacgtataatacgtgaaatctatgtaatctgcgcctaaattctcttttataaaatgaattttgaaccgctacttgactataaaaaataaattatggaagaactgaccctcactactcctgccctacttttctcggcagtttcattgattttattggcttacaccaaccgtttcttatcgtatgcccaacttgtgcgccaactgcgtgaccgctacgtggagaacccttcggatatcactgaagctcaaatcgagaacttacggaaacggttgaacctgacccgtacaatgcaaggactgggtattgcaagtctttttctctgcgtagtcagtatgtttcttatttatatcggactgcaattattttctgcttacgtattcggactggcactgattctgttgatagcctctctaggcgtatctttccgcgaaatacagatttccacccgttcattggagatttacttgggaacgatggagaaagggaaaaaccaaaaataacacggttgacaatccctcctattaagttttatcaagacactacccggcaaggaaggatgaccgtaaagcgacttcccttgcctacttcggatttgagatcaatccttccacccagtttttctataattacctgacaaatagaaagccccaatcctgctccctgtgagaattcgttctgtttgtagaaacggctgaaaatcatccgttgttcttcgcgtggaatacctctcccagtatcttctacataaatccgcacatgcccctcatccggcagataaatataccctaatttgatatatccgatttccgtaaatttactggcgttattcaagaagtttgttagaacttgtatcaaacgctctctatccacattaatttccaaaggtatattatccacttctttcaggaattccagacgtggagcaatcaagacctggtgagtcatataaatgtcatcaatcagctctctcaccctacatttcttaaacgagaaagacatatagcctgattcgatacgagaaagctccagaatatcgttaatcaatttgagcagcaactcgctgttcttattaatagtgccgatgtattcttcgcgttctacggaactcaatccatcttccaatgccagaatattggcaaagccaacaatcgaattaagtggagtacgtatctcatggctcatatttgccaagaatgattgtttcaattccgccttttcagcgagtaagcgtgcagcttccagttcctcctcacgatcttttatatcttgtatgttgagcagcaaacctgctgttttatattcaccacccgaaagctgtttagtagtataacgaaactcccaccactgatagcctttaccgtcgaagttacaaagctcctgcacaatttttttatgagcacttttcagatttcgccagttgaacttcactccctcccaatgatcgggatgaataaagctcatgaattccttaaacgaaagttgtctaggatttagcccttgcgacgcccagaatgcatcctcaaaaacaaaacaacccttatccaatctccaagcatacgtcattccaccctcaatggctaatgacaatgtttctttttcatcagccaatgctataagagcctgttttttcctcatctgttcccgaagatatagccaccaaagagaagcaaaaagtaaaatcaggaaaagaacaaatgaagcgactaaggctccccacaaaaacggatattcatctctgaacggaatattgataatacgatagttagcaggaatactttccttactcaaaccaatttgcgtcattgtattccagtctacgacatactctttccggctttcaacaatgggtatatccgaggggcttgcgccatgcaatatgcgaacggcagttttcacctcttcttctacctgaataggcagcgaagtgatgtatccacccaacaacttctcaccaaacccaaaggcttcattgatggctgtcagactaggactaccacagatactcccaatattaatagtggtgtaatcacgtttcaactggatataacattgatcgcggtaactcctgttcaaaacccacataaaagtagcatccgaatggtttctggcattacgcaaaggaatagccatgaaacgggtatagccttcttcctgtgccaaacgtatctgttcttcaggagaaagctcgggattatctatgaatccggtcactttatgtcctttaaactgttcctttgcatctcttctgatttgtctgtcgatataggtagtatcgagcatggtaaacaaacgaacgtgctcaccgaaaagctcttttgccacactgatattctcattaaaggctatcttgtcatggaagcctgtcacgttgggatgatgtttcagtaatccccaattcggataattgacaccaccaaaaaccacaggcacttctttcgccaacagaattccgcatttcatcaatgaataagtagcctggtcttcattcaccagaatcacttccggccgccagtctttcgatacggaatcaaccagaaagcgcatccgctcaagttccggctcttcccagtaggattcacagtctaaataaacggtacgaatatcagcatcaattttctctttttcaaattgctccgctatcatccggttaaattccggataagccgcataagtctcctcataagagtggataaccagaatacgccgttcttctttttgagaacaactactcacccccaaaaagagcaataaaaatacagggagcaatctaaaaattcctctattcacaccattcatttataataatcgggattaatttttctctgactcgtaatacaaaggtagtttattttcgaacatataagcctaataagtgaaaaaaaagaagctgtctgaacagaaattcaggcagcttctatctatataaagaactattttttcagagtagcatcattaacgctgtcccaattgtgaatctacaaagaaaattccggtatcaccagccttcttgatcttgtcaacaatgccttgtgctgtagcttcttcttctacttgttcgcgaacaaatccccacaagaaatcctgtgttgctttatccttttcagcagcagctacgtctaccagcttgtctaccaattgagaaacatgacattcatgtttgtatacgtgttcgaatacctccagaggagtaccccatccgttaggaacaacatctattttatctactttagcagttcctccacgtttgatgatataatctgccattgcataagcgtgtcccatttcttcctgggattgctttttcatccaatgagcaaaaccgctgaaaccttctttctcaaaatagaaagacattgctagatacaggttagcagaccacatttcagcagtaatctgttcgttaattgcattctgtaatttttctgaaatcataatcgtattttttattaagttgttaatgtagtttctttttgaactcattacaaaaataacaagctttcagttaaaattgttccatgcaccctatatttttaaactacattcacattttgattgtagcggttcattttttacttacaccagttcgtcggaagtatatcctttcggcagttcacgacagttgtatccggaagccattatttcaccataagcaccagcagagcgaagggctatcaagtcaccacgcttcactttgttcaggtcaattgcttttccgaaaacatccgacgattcacagatcggtcctactacatcgtatgcctccaatggttcttcggaagtaatattttccattttatggaatgcctgatacagagccggacggataagatcggtcatacctgcatccaggatggcaaatttcttccgtgtgccttgttttacatacagaaccttagagattaaggaaccgcactgtcctacaactgcacgtcccaattcaaaatgcaaggtctgataaggacgtaatttcagttgtccggcataggtagcaaagtaatccttgaagttcggaatagcctgacggttgggatgtccgtagtcaattcccaaaccacctcctacattgatatgttctaccagaattctgcgagcttccaatttatcctgcaattcattgacacgattacagagagctacaaaatcgcccatatccagaatctgtgaaccaatgtggaaatgaagcccgataaactttacgtttttcatctcctgcgccacatctatcaccttgtccatatcctgcatgctgataccaaatttattttctgccaaaccggtagtgatatttgcgtgagtatgtgcgcctacatccggattgatacggaaagcaacattagccaccttattttgagcagcagccaattcattgattacttccagttcgggaatagactctacattgaaacagaagatgccgtactccagcccgaggttaatttcccagtctgctttacctactcctgcaaaaacaactttattggccggaaatcctgcacggatagcggcacgaatttctccaccgctcacacagtcggctcccattccgctctcacggatgatggtaagtactttcgggttagcatttgctttaacagcgtaatgcactgaataattaggatatttggcaacctcatggttaatagccgacaatgtatcgcgcagcactttggtatcgtaataatagaaaggtgtctgcaaagtgcggaatttatcgattggaaatattcccttcataattcgaaaaacttgtttagttggttaaaaaagagcgcttttatcagttcggtaaaagcgctcgtattatttgtggaattatttgccgttgaaaagcatatcgctcaacgattgtaaagctactttcttatcacactcccgaatgaggaaggagatgttatagttacttcctccaaacgagatcattcgcaccggtatatcgcgcatcgcatcgagtgcttttgcttcaaaaccgacattttcccattcaaggtcacctacaacgcagatgatacacatttctttatcaacggttactgttccgtatttcttcaggtcgtccagaatctcattaagatgtttcgtgttatctatcgtaacagatacaccgacttctgacgtacagatcatatcgatagatgtctgatagctttcgaagatttcgaacaccttacgcaagaaaccatgagccaataacatgcggctggatttaatcttaatagcagtgatgttatcttttgcagctactgccttaatcttgcctttttccgtatcgttagaaatcagtgtgcccggagcctccggatccattgtgttcaacaagcggacagggatattggcatatttagccggctggatacaagtagggtgcagaatctttgcaccgaagtaagccaactcggctgcttcttcgaagtgcagctggcgtaccggagcggtcttgtcaacaatacgcgggtcgttattgtgcataccgtcgatatctgtccagatctggatttcggaagcgttcactgctgctccgatcagagaagcggtgtagtcgctaccaccacgttgcaggttgtctatctcaccgtaagcattgcggcagatgaaaccttgcgtaatgtagatttccgtatccggataaagatccaattgagcacgcaatttatccttaatatatacggggtccggttctgcgttcttatcagtacgcatgaattccaaagccggaagcaacacggacttcacaccgcattcctgcaggtaaaagtttaccatcgccgtagagataagctctccctgtgccaaaaccactttctcttcgaacaaagtgaaaaggtctttagtataggagcggatgtagtcgaagtgggatttgacaacttcaagacctttctgtttatattcctgggttgcaaaaagctcatcaatatgctgtttatattttgcttccagcttattaataatctcgttggcaccctccggattcttcttatacagatagtccgaaatttccaccaatgtgtttgttgttcctgacatagcagaaagaacaacaatcttctgttcaccatcggtaatcaatttggctacttccttcatgcgctgagcagaacctacggaagttcctccaaactttaaaactttcattttcgttactgttttagttatctatatttaaatctatttctattgttctctgtctgggcatatattcatcagtcacatctacaatctgatggtcggcacaacgatataccctgcccggataatctttcaacagttgcaaattgtgcgtcgtcatcactaccgatgagccggattcgcagatattgtgcaacaattcaacgatggctttacctgtttccacatccagatttccggttggttcatccgccaggatgatagccggagaattgagtacggcacgtgcaatcacaatgcgctgctgttcgccaccggaaagttcgttcggaagtttataacctttgttggacattcccaccagttgaagcacttcttcaatacgatcctgtatctcctgtttgtttttccagcctgtggcacgaagcacaaattccaggttattatatacagtacggtctgtgagcagctgaaaatcctggaatacaatgcctaacttgcggcgcaattgcgggatatgcttacgtttgatagatcgcatattatagcccagcacttccgcttcaccgtcaattacatccagttcgccataaagagtcttgagcagactcgtttttcccgagcctacttttccgatcaaatagacaaactctcctttgtgcaattccagatttacatcacttagcacacagagttcctgttgatggatttctacgttcttatattgtatcaacgccccgtcatccatgccgactcccgttttaatttttaatttctaatctttacttattaatgcttcttccaggtactgctatgtctttcctgcagttcacgtgcaagatcttcaatgcgatagccttttgaagcaagcaatacaatcatgtgataaatgaggtcggctccttcgtagatcaaacgttcgtcagtaccgttcgttgcttcgatcactgtttccacagcttcctcacctactttttgagctatcttattgattcccgactcaaacaggctggttgtataagaaccttcgggcatttcttcgtgacgtttgtctataaagtcctgcaatgctttcaggaacatgaccggttcttcgtttttctccccccaacaagtatctgtgcctgtatgacacacaggacctaccggttctacttgaatcaataatgtatcattgtcacaatcagcctttatagatacaacatgaaggaagttaccgctttcttcgccttttgtccataaacgattcttcgtacggctaaagaatgtaacttttccggtttccaccgttttatcataagcttctttattcatgaaacccagcatcaagaccttacgtgtctcgttgtcctgtatgatagccggaacgagtccgttcattttatcgaaatccaattccatttttatataagttctaattactattccaatttacaattactacctattcgcctacggaattcttttgcagacagttcctatatttatctgactatataatccatccgcaggaaaacccggccggggtgcctcaccccctgatggtaattccttcgccgcaaagatacgattttaattcgggaattttaatttctccgaagtgaaaaacactggcagccaatgcagcatctgcctttccctgtaaaaagacatcacggaagtgctccttacagcccgcacctcctgaagctatgatgggaatggagagttgatccgctaaagcggcaagtgcttcatttgcataaccggcttttacaccatcgtgattcatgcttgtgaagagtatttctcctgctccgcgttcctgtgcttctttagtccactcgaacagatctttatccgtttcgatgcgtcctccgttcaggtaacatttccaaccgttttcggtctgtttggcatctacagccaacacacaaacttgtgagccgaaattctttgctatctcgtcaaccaaccggggattacggatagcggaagaattgatagaaatcttatctgcccctgcattcagcagacggtctacatcacttaattcattgattccaccacctacggtaaatgggatattgatattagcagcaatccgttttaccaattccgtaaaagtcttacgtccttcatggcttgcagtaatgtccaggaaaacaagttcatctgctccctgttcactgtaagcacggcctagctccaccggatcaccagcttgacgcaagttgacaaaattcgttcctttcacggtttgtccgtcttttatatccaaacaaggtactattctttttgctaacacaatcctattttatttattgttcaacaatttataatctatattcctgaagctcgattcttatcttccttataataaaggtatcttatttattccgatacgctcattatagaaagattctcaaatcttgtaaggtgatatgtccttcgtataatgccttaccgaaaataactccgggaacaccggcctcatccaaggcaacaatatcatccatcttgctcaccccgccactagccatcagataaaggtcagggaattttgccagcatctctttatacaaatcgatagaaggaccactcaacattccgtcacagctaatatccgtacagattacttttcgtatacctttatctatataattttcgagaaatggaaaaagttcacaggcactttcatctttccaaccattgacggctatcttatgttcttttacatctgcccccaaaataatcttctcactgccgtatatttccagccaatgacagaataattccggatctttcactgcaatgcttcctccggttaccatctgcgcaccgctctcaaaagcaattttcaaatcttcatcactctttactcctccaccaaaatctatgacaagagaagtgcgtacagcaatctgttccaacacccgatagttaacgacatgatgagaagcagcaccgtccaagtctaccacatggagcctgcgaacaccgttcgcttcaaactcctttgcaacttccaccgggttctcattatacacctttttactatcgtaatctccctgggaaaggcgtacgcactttccatcaataatatcaatggctggaataatttctatcatctatttactatttgtatcttagaggtttaaaaagtttgtcagaatcttctctcctgtcttaccacttttttccggatggaactgggtagcataaaagttatctttatggagcgcagcactgaacgggtgaatatagtcagttgtagcagcagtaaagtcgcaggtcggcacatagaagctatgcacaaaatagacaaactcttcttcggtgaacccttcaaacaatttgctattcgtttttccaatggtgttccatcccatgtgcggcactttatcctcatgtttctgcgggacaaaacgtttcacatccacatcaaagatattcaaacaatcgacttctccttcttcggaatgccggcacatcaactgcatgccgagacaaattccaaatacaggctgacggagattcttaatcagttcgtccagtcccgttgccttcaagtggttcatggtagtttccgcctctcccactccgggaaaaataactttatcggccgattggagttcttctttatcagcagtaatcaccgcttctacccccaaccgctttaaagcataatccacagaacgaatattgccggcattgtattttacaactgctactttcatcagctaaatattactgttttatttttataagctaaaactttgcgctcgatgtgcttctgcactgcacgcgaaagaacgattttttccaaatcctttcctttatttacgaggtcttcaatagcatctttatgagtaatgcgcactacatcctgttcaataatcggtccggcatccagctctgtcgttacataatgactagttgcaccaataattttcacccctctctggaaagctgcgtgataaggcttcgcccctacaaacgcaggaaggaaagaatgatgaatattgataatcttattcggataagcattaatcatctgttcggagatcacctgcatatagcgtgccaatacaataaatgtaatcttatgtttggcaagcaattccatctctttgcgctcctgttcttctttcgtctccttggtgatagggaacagatagaaaggaattccgaaacgttctgctacgtgctgcaaatccggatgattacttataataagaggtatctctacattccactctcctgccgtataccgggctaacatatcgaaaagacagtgtgacagcttggatacgaaaatagccatacgtggttttacatcagagaaataaagacgaaaatccatttcatatttttgcccgtagagtgttctgaaataatcttcaattttttcctgtggaaccagaaaatctttcagttcccattcaatacgcatgaagaagatgttctctacatgatctacatactgatccagatagataatatttcctttgtttaccgtaataaagtctgtcacttccgctaggattcccggtttgtcgggacagtgcaataacagtttggctgttgtcatcattctttctactaattaacgattctaggcagattattttctacctttctaattttagtccgcaaaaataacgatttattgcaaaattacgaattattcaagcagaaagttgatataaaaacggtgatttcttacagatagaaagatatcgagagttattttcaatgaaaagaatgacaaactttaggatagtgatgccattgccttcggatagtgacggtattccatcgtgatagcgtcactataacgatcagataccgtcactatccgaagagaagaaaaacgaatattttttttcattacaaaagtactcaaaatgagacactaagcatttttcttgttttttcttgaaaaaaacttttctcaaaacgcttgcaggtttacaaaaaacaactacctttgcacccgcaatcgagagagatgcagattaataaattgaaattctggtgcgttagttcagttggttagaatacatgcctgtcacgcatggggtcacgggttcgagtcccgtacgcaccgcttctttcactaagaagcagagagaaatagaaatgagttaatccaattaaaatttggtgcgttagttcagttggttagaatacatgcctgtcacgcatggggtcacgggttcgagtcccgtacgcaccgcgaaagcaaatagtaaattaaagcaaagctctgaaattcaagaaattcagagcttttttctttttcttcagttcatttaaaacagagtttaagtaggcgatagatgtgcccattcaaactctacaatgattttttaaccaatcattttattcaaatgtaacattacatcttcaattaaaggtacctatactaagcatctgtttataattgaacagagactacaactgcatgtgtaaaataggatattccttaccttctccgtccaaattcgaccttttatatatgttaaaacccatatatttataaaaaccgacagcttgaacattttgctcattcacatcaactttagttacttgcaaattatctatggcataagttattaatttttttccgattcctgcgcctcgatacttattgtcaataaataacatttcaagatttccttctgcaattcccataaatccgattaagattccctcttgttcaaatccgaatagattaacatactgaaaatataccggaagtcgttccttataatataaaaaatcttcctctttaagaaaatcatgtgtactcaatactgcactttcccaaatttccatcaaacgtggataatccgtaactttaatttttctaatcatacttgtaattgcaatttaaagccgcaaagttcgttacttatacattcaaaacactgaacccaagttaaaaaatacgtttacggattctgcttagtgcttgcggtgtgatacccaaataagaagctatatcttttaatggtatatagtttaatgtaataccatattcttccatcatctgtagataatactgttcaggagaatatttaatcaagtcgatatttcttttcaaaagtttattcaacaatatagcatttaaatcttcaaatacagtttttactttagggatagcggtatatagttcatttacttgcttcttgtctattcggtaaataacactatctacaattgtttgcacattaaatgcagacctagtttgtaatgtaaaagatatgtttgacattgaaaacgtaccctctttacaaaaccagaaagtttgttcttccccgttatgatttaaaagccaacagcgtaatattccatcaaaaacgaaataactatacctctctgtttctccttccttaatcaaaaatgtacctttactaactaatattcgttcaaaatattggtcgaataacttaaactcctcccaattaaaaatattagtactaaaattaaattctttaagtagtttttctaaaagcataatctaaatatgattcgtaatatacttactcatttaatatattcactattacttccgccctatttaacttctcatatttagtgaatatattttcagtagccatttttatattactcctttcgcccactctccggcctgcttgacacttccgttcaacaatcggctttctccccatacgatttttggataaagtttcttgagttgttttacactattagttattgagcttcctccggaagtagcaaatggaataacggttttaccggagaaatcatatttctcaaggaatgtattgaccggacgcggacataaattccaccatatcgggtaaccaaggaatatcacgtcgtaatctttcagattaagcgcttctccccccaattccggacgtgaattttcagtcgtcatttcaattgaactacggctactcttgttgttccagtcgagatctgccgaggtataggctgtagcgggagttatctgataaagtttgccgccaaccgtttttgcaatggcatcggcggctttttctgtagttccagtacaagagaaataggcaaccaggattttcttatcggactgtacattagtatccgctgtctgattctgcgcttttgatgagcagctaaagcaaaggagactcataaatatgaatataatctgtttcattttattttgattttaaatatttcttatcattaattagtttagacattatcacgatggagtaaccccacaggcgttttcattcttccattactttgataattgcccatatcgtccatcaaacgatgtatttcttctgtattaagcgctttgcgcgtctttacatattccttaaaattcctcggtagtcatattatttcctttcaaaagataaagcaggattagcaaaaatcatcgtttagtctgttcgagtttgttatactcgtcatctgtgaccggctcaagccactcattggaagtgttttcaccggaaacttcgaaagccagatgagcaaaccaactgtcggcagcagctccgtgccagtgtttcacattggcaggaatatggataaccgtaccaggcagaatctctaccgccggtttaccttcttcctgataccagcctcgaccggctacaccgataagcatctgtccgccacctttcgttgcacggtgaatatgccagttattgcggcaacgtggttcaaaagtaacgttagagatattcacctgctcgcgcgaaaccggagcaagataactgttaccaataaaatactgtgcataggctgtattgggttcaccaatagggaaaatcatctcacgctggaaagctgttttggcatcctcaccaacaatatcttcagaccatactccttttgccaaattgaacgctgcccacgctttcggccaacctgcatagaaacctatatgagtgataatctctgcgatctccgtgcgggtgatgccgttcttcttcgccgactgaagatgataaacgagcgaattgtccgtgattcccatactgataagggaggtaatggttactaaactgcggtcacgcagaccgagtttgtcagtgcggctccaaacttctccaaagagaacatcgtcattaagttccgcaaacttaggggcaaacgttcctaactggtcgcgtcctgccgtctgtactatcttttcttgtgccataacattgagtgttaaaatactaaatactgaaaataaaaggagtttattcataatcatttcgtttattgaatgaagttattaatgcaatttgcggggttaagcggcatttggtcagagagtacgagagtcttaaccatgtgcagcgttccttgcttgtacttttgaaaatgctccgatgcaatatgagatttataagcctcctgactcgcgtaagtttcaagaatagttatcctgccaggattctctttttcgctgacggcatacatagtcagcactcccggttcagtacgcaaggagacttcacccacttcggtcgcatatttcatatattcttcaagatactccggataaacctcgatttttgatagccgcacaataccgtcagccgccataggtaatttggcgcacataccaggctgctgttttatatcctttttccctgtcatactgcatgataacataacgaataaagacaaaacacttagaattgtttttatcaccatcttctatcttttcattgttaaacttctgattgcaaatttactgcgataaaacgaatggaattgtatatcaattacggatttttgtacccaaatccccgattctgcaataaagaaccgtacataattcgaatgaaatgaattatattgccaataaacaaacaggcatattaaagatgaaaataaaatccaaataaatacaactaaatatgctttatatcagttctttatagggtagttatttctttcagttgttttcactattttctgttaattggttctttttgggtacatttttgtttcttgtttgtttcttgatttcagttttaattcgtacatttgcatacgaaaaataacgaatgaaagaatacgattatgccacgaataaagaagcctaaaaaagtaaaagaaccaatccgtcttcggatgaaggatttgtccgatggcagcaaaagtctgtatctggatatataccgcaacggcaaacggacatacgagtacctgaagctgtatcttattccgggaacggacagcaatacccgtcggcaaaatgaaataacaatggctgccgcaaatgccatcaagtcgaaacgtattatcgagctgaccagtggtgaagccggtatcgtgaaccatacggataagatttatctgctggactggatgcaaacctatctggagtaccaagagaaacgcgacaagaagggcatcggtcaaatcaaagccgttacccatatcctgaaagaatatgcaggggaaagatttatattggatcgggttgacctcgctttttgccaaggctatatcgactacatgctgacaaccttccgccctaaaggaaagccgatagcagcttctacacgcaacacctattatcagatattcaatggcgccctgaatgctgccgttcgggctaaacggttgttgagaaatccgtttaacgagatggaaaagtcggagaagcccaaaatgccggaaagcgtgcggtcctatatgaccatcgaagaggtacgggcattgattgccactccgatgcaggaagggagggtaaaaaatgcctatctgttctcctgcttctgcggactgcgtatcagcgatattgtcggcctgaaatggaagaatgtctttgtcgataacggccaataccgtctggcggtagctatgcagaagaccaaagaaccgatttacctgccactctccaacgaggcgttgaaatggatgccggagcgtgaggacaaggctgcagacgatcctgtgttcaacctgccttcaaatatcaatcagtatctcagaccgtgggccgaagcggccggaatcaccaagcgttttacttttcacaccgcccggcatacattcgcgaccatgatgctgacgctcggtgcggatctctataccgtatcgaagctgcttggccatacctccgtgagaatgacacaggtgtacgccaaaatcatcaaccagaaaaaagacgaagcagtcaatttggttaacggcctattcgactgatgtagtcatacatgtcaaattcaatttaaggtaaatatttccggcttttctccgatatttcaaatggtcgaagtaatgccactattataataagtataaacccataaaaaacaattcgacatgaaaggacaaaacaacaggtcctctctttttttgaagggagaccacatctgcaccacttcgctacggaacaggatgtagcggaagaattttacgagttgctctccgaagcaagggagctttatcttcaagacgtcatgacaggcggcaaacgatatggccgctacgtggatgactttataaacagccaccggtacatcgactgcaacagtgcggtttgcaggaattgccatgaaatgaacattcatatcatcagagggctgttgctcgattgtacaagtctcgtcaaaagcctctttaccgcagaaacattttctttcgaggagtgcatggccttgaaacaaaagtacgacattgccggagtatggttcgactcttcacgtatagaagattccagaaacgctccacctctctcctttggttgcaatttttcccgtgaacagatgacaggtattgtggcttgcgccaacgcttatcatctgttttgcgtttccactctccgcatcgaggacatggaagcgctttttgcctgcaaggagaatttctgtatacgtgtgaacaatatccgccatgtggcggttctgttcgatgcgttgctcgaaaacacctttatcctacctcactggcagtcggttctcgacaaggggcggttcctgttgtccaaagacggcacaagatatgttaccgcttcaagcctctcgtctgccctctctgcggcgaggaacaacattacatcggcaaacctcggcatacgaaaagccatcagtcggctgaaaatatgacacgaagtgccaaaaagccaagtatgtgaaagataaaacagtgatagttgccgtgatacgtgcatagtatcatgccggaatttccggctgtccggttcacatcacataactttgacctccgttagcgcgctgcataacggaggtaactctccattgtctaattttaacatgtattttatgcaaaacagaacaacattcatggagcggttaagcgaacggctgaccgccatagaagcggttctcaagaagttggaaccggtggaaggtctgttggagcgtgtggctttactggaaaataccatttacacgaccaagaaagtcttcacttttcaagaggcgtgcatgtatatcggcgtgtccgaaagtatgttgtacaaactcacatcgaacaaggaaatcccgcactacaaacctcgcggcaagatgctttacttcgcgaaggaagagctggacgcatggctcttgcaaaactacgaacctacggtggacgatgccatgcgtatggcgacggaagtatccgcaacccaaccgttctttaaccagaagcgctatggaaaacgaaaaaagaactgaccgtaactcgtgggcggaactggacgagaatcgcctgtcggatattctcacggcatcgcagataaaggccacggacacctacgtgactccgccccagattatatggatcgacaactccaccatagcgacgctcggcaattttagcgcttcgacgggtaaggcgaaggcgaaaaagacgtttaatgtctctgctattgtcgctgcgtcactggcgggccggcaggttttgaactaccgggcgcatctgcccgaaggcaagcgcaggatcttgtacgtggacaccgaacagagccgtttccattgccataacgtgttggaacgtattctccgcctggcgggactgcccaccacaaccgacaacgagaatctcgatttcatttgcctgcgggaatacacgccggccgtgcgtattgaggtcatcgactacgctctgcgacagaacaaagggtacgggctggtcatcattgacggcatccgcgacctgatgctcgacatcaacagcaccagcgaatcggtggaggttatcaacaagatgatggaatggtcgtcgaaatacgacctgcatatccattgtgtgctgcacctgaataaaggcgacaacaatgtgcgcgggcatatcggcacggaaatgagcaataaggcggaaacggtgctggtcatcaccaagagtgcggagaatcccgttatcagtgaagttcatgcgctgcatatccgcgagaaggagttcaaaccgtttgctttttccgttgatgacgaaggattgccggtcatggtggataactattcgtttgatggcagcgtgagaccgaaggcccggagcagcttcatggatttgtccatcgagcagcaccgggaggcgctttccgccgctttcggggacaggcccatcaaaggtttcgagaacgtactgcaggctctcatggcctcctatgaggctatcgggttcaaacggggacgcagcgtcatgataaaactgctgcagtacctgacggaaaacctgaagctgatcgtcaaacgggacaagctcttttattacgatgtgaccccgaccgaagccttgcttttcgacgaagaatgcgaggacgcagaaggtgaaaaataatttagtttactttggtccgggtatatataggagaaaaaccaaagtaaaccgttttttgaaaacaagtgaaaagaaaatgacatgaccatagcggaagcaaaacaactgcgtatcgtggactatcttgccagtctcggctaccacccccagagtgtaacatcgaaacaatactggtatttgtcgccgctacgcaatgagcgtaccccgtcgttcaaggtcaatgaccggctcaacgaatggtatgactttggcgcagcgacgggcggagaccttgtggaactgggcaaacacctttaccagacggacagcgtgagcgaagtgcttgcctatatagggaagcacgagaacgctatcccgatacaaagggtgcggattccggggacaacgccccgacccgtcgaagccgacatgaaggacgtgctcgtcgtaccgttgcagcaccatgcgctgctctcgtaccttcattcccgtggaatcgacggagacatcggccgcatgttctgccgggaggtccattatgaattgcggcaacggcgctacttcgcccttgccttcggtaacgtggcgggcgggtacgaggttcgcaatccttattataagggctgtatccggtgtaaggacatctctgtcatcaggcattctcatagtgaagcacagaaccgggtttgcgtgttcgaaggcttcatggattttctctcttacctgacgctgaaacagacgggtgatgatacggtctgcatcggcgcaccttgcgattacctcgtgatgaactcggtgaacaacctgaaaaaggctttggaacacttgcaggtgtacgaggaaatacactgttatctcgacaatgatctcgccggacagaaaacggaagagaccatcgccggcatgtacggcaagcgggtgcacaacgaagcactccgttatcacgagtacaaggacctgaacgattacctgcgcggaaagaaacggtaaggcattatcgttacccctcccttgaaagctctcctcccggagggctttttttatgcccgtttttcccggtacattcgccttaaagtatgaaattaaagttcaatttatatgtttcatacttatttatacgtaataaaatattgtttgatataaatagttttcattatatcaaatataatacttttctttgcttttgtactttcaaagttcaattaaagtttaatttcatacttaaaacagatgagttcatactttatattcgcccttgtactgacggtgctgtacatcgtctattacgcggtcaatattacccgtgacctgtatggaaagaagggaacggagaagactgacgaagaagttttcgacctcggtccgatggatgccacggaagagagtgtcgaggtttcggagaacgagaccgggtttagtatcggaaatgagacatgcgacacggaagccgtagctgccccgcctgcggtacaagacggcgatacagggaaaaaggaggcagccgcgaaagagcggcttgaaaggctgaaggccaaggcggaggcgcagatggaagagatcgctccctacctgtccgacggctttaccgacgaagagatgtataaggcgttgatttccaaaggacgcttggacaaccgtccctgcctgaaatggagaccggtcaaagataagctgtaagatgtcgaaaacgaaaaagatactatgtgcgctttgttccatcatcccctgttcagctctggcgaaaagcggcagcgtgaattacagttggggtgcggatgcgctggcgacgatgcacgactacgtggtaacaatgatgttttacgtccaagctctctgttgtgccatcgccgggatttgtgtgattgtgtccggattccagatttacgtaaagatgaacacgggcgaggacggcattaccaagtccgtcgtaacgcttgtgggcgcgtgcctgttcctgatcggtgcgttcctcgtctttcctgcctttttcggctatcgcatatagaaacgggaggcaggaatcaagtaccgccataacgattcgaaagaactgcaatacttaccctaaaataaataatcatgtttcaaaaaacaaaaagacaaatgaaaaaaatgttttctgctaaaaaagtacagatgctcacactgatgttgctgtgtggcacgacggccgtcatggcccagaactccgcaggcgattattccgccggtacgactgcactggctaccgtgacggaggaaatcgccaagtacgttcccatcatggtcaaactgtgttacgccattgccggtgttgtggctatcgtaggcgctatctcggtgtacatcgccatgagtgcgtccgtaatggttgcatgataaattcctctttagcaagaggataggtcagggttcaagtgatctacttccacccaaataagcccgaggggaaacctaaaggtgaaaatagcactttgggaaagcaataagtcagtcaaaagccagactgcgactgaattgcgagggagaaagacagatatgaggataaagtccatactgattgaacgatagcccagcggcaaaagatgtagctgcgacggaaggcttttacaaacgtcgcattgtggcactaagacaacgtcattggtgttatagcaaagaaccagccacaacgcaaccgcagtaagcggagaaaagggcggaagtcgtatccgacaatctgtcgtgctaatagttatcatacagctaaacggagattacctaagttggaaagccatgaaagtggctatgggctttggctctgaatatccaatatggtaacggagttcccatagtagtccgagcaaggtaatgccttgtacatggcgaaggggaacagttagtaatgttttaatacaaattttgaaaacgtgtaagacgtatggaaaaatcagaaagagtattaaaagctctaagtgaccacagtcaaagttcggattataaatacgagcgactgtatcggtatctgttcagtgaagagatgttcgctgtagcctaccaacgcatctatgcgaagcaaggcaacatgacacccggaactgacggcaagaccatcgatgagatgagtcttgaaaggattgaaagattgattgtgtccttaaaggacgaaagttaccaaccccaccctgcacgcagagtgtacataccgaagaagaacggcaagaaacgtccgctcggtattccctcattcgaggacaaattggtgcaggaggtagttagactgctgcttgaagctatttatgaaggtcattttgaaggcacttcacatggtttccgaccgcatcgaagctgccacacggcattgggtatgatacagaagtcttttgcgggagcaaagtggtttatcgagggagacatcaaaggcttctttgacaacatagaccacaacgtactgattagcattcttcgtgaacgcatatcagatgaacgcttcctcagacttatccgtaaattcctcaatgcagggtatgtggaggactggaagtacaacaagacgtactcaggaactccgcaaggtggaataatcagccccatgctggctaacatctaccttgacaagttcgacaagtacatcaaggagtacgcagccaaattccgcaaaggtgacagacgcagcatcaatcccgaatactggcgtttgaacaataagaagaactggctgaaaaagaagttgcagaaaacatccgatgagcagatacggaaaagctatctgtatgaaattgcccaactgagcaaacagatgctgtccactcctcacaaggatgcaatggatgcggactttagaagaatgcagtatgtaaggtatgcggacgatttccttatatcggttatcggaagcaagtctgaatgcgagaccatcaaagcggacatcacccaattcatgagagaacaactcaaacttgaattgtctgatgagaaaactttgataacacacgcacaagacaaggcgaaattccttggatatgaaatcttcatcagaaagtcagacgcagtgaaaaggaataaggacggagttctcaaaagagacttcaacggcgcagtggtgttaacccttaactcggctgtgatacaaaagaagctcactgagtacaacgcgttggaggtcagaaacattgatggcaaagacatttggtggtcaaagcctcgcagatatatgactccaatgaagcccgaagatattcttgcccaatacaatgcggaaaccagaggactttacaactactattcacttgctgcaaacgtgtccaaagaatgtgcatctttcgccttcattatgaagatgagtatgttcaagacacttggctggaaactgaacacttccgcaaggaaagttcgccagaagtatcagaaggacaaggactttgtcattccgtacaacgatgccaagggaaagcagaaatacagagtcttctacaatgagggtttcaaaaagagaaatgctcagttcgatgttgactatgacaaactgccacagaccatgtacgtgccatatccgagccttgtggaaaggttgaaggatggcagatgtgaactatgtggtaaggaaggaaaagtagtcatgcatcatgtgaggactctcaccaagctgaaaggcaataatgagtgggagaaactgatgctcaaaagacatcgcaagacactggttgtctgtgaggactgcaactctatgattcagaactatggtaaagagtaatgttactaatggaaagccgtatacatggagacatgtaagtacggtttgggggcgagtactcggaaaccgcccaccgcaaggtgggtatggcgctgggtgcttagcccacacaacgaggaacaggacgtgaagaagaaaatcatgatggtcgtgggcgcatgtattttcttaatcgctgccgcacaagcacttccgatgttcttcggtatcggcgcataaaccttccgcacgatgaaaggcaaggacgaacgttaccctgactacccgctgttcaaaggtcttcaacggcctttggagttcatgggcatccagggacgctatacctactgggcggcaggcgttgccggcggagccatcgtcggctttatcatcgcctactgtctcgcagggttcgtggtcggactggtcgtgctggttgcggtcgtctcgacgggtatcgcccttatcatgctcaaacagcggaaagggctgcataccaagaaagacgggcgcggggtgtatatctacgcccactcgaagaagctgtgagaagaaaagaaaaaccatcacgggcaacgtgtggtcttgttgaatgttgaacgcgggccggccgcctgaaatccgggcggcccggccttttttatcgtattttaagatgactttgtacatcattctactttttatcgccttgtgtgccggcatggccctgtcggtctatgcgttcggtaccggaggcaagcgcaagcgtatctttcaggacatctatttttccgtggaagagacgaacggcgtgggcgtgctctataccaagacgggcgaatattctgctatcctgaaaatagagaaccccgtgcaaaaatactgcgcgaacattgacagctactatgagttcacgcaccttttcaccgccctcgcacagacgctcggcgaaggatatgccctgcacaaacaggacatcttcgtcaggaaacagttcgagaacgagacgggcgacaaacacgagttcctctcgtcggcctacttccgttacttcaaggggcgcaactacacggacagcgtgtgttacctgactatcacacaggaggcgaagaagagccgactgttctcgttcgacaacaagaagtggcgcgattttctggtcaagatccgcaaagtgcatgaccagctgcacgatgccggggtacaggccaagttcctgaacaaagccgaggcgagcgaatacgtggaccgctatttcgccatgaacttcaaggaccggatcgtgtcgatgaccaacttcaaggcagacgacgagacagtctcgatgggcgacaaacgctgcaaggtatatagtcttgtcgatgtggactgcgccgcactgccttcactgataagaccttataccaatatagaggtcaataacacggatatgcccgtggacctgctggctgccattgacagcattccgagtgcggaggctgtcatctataaccagattgtcttcctgcccaatcagaaaagggaactggccctgctggacaaaaagaagaaccggcacgccagtattcccaatccgagcaaccagatggccgtggaggacatcaagcgggtacaggaggtcatcgcgcgggaaagcaagcagctcgtgtacactcatttcaacctgattgtcgccgtaccgactggtacggacctgcaaaaatgcacgaaccatttggagaatgctttcggacgtatgggtatccatatttccaaaagggcgtacaaccagctggaactgttcgtaaactcgtttccgggtaactgctacggcatgaacgaggactatgaccgcttcctgacgctgggtgacgcggcggtgtgcctgatgtataaggagcacatacagcacagcgaagaaacaccgctgaaaatttactacacggaccgccaaggcgtgccggtagctatcgacatcacgggaaaggaagggaaaaacaaactgacggacaactcgaatttcttttgtttagggccttcgggcagcggcaagagcttccacatggaaaaaagcagaacaaaacggaggcaaacggttgcaaaaatcagcgttgtaattacttgattttcagctaatatgttttaacaaacggaaaattcggctattggcgtttagtcctcattagagtaattttgtaccacggttgtacctcgcaggaggggtcgcacggttcgatttcctttcagcagcgtgcaacagcgttcaacaatgtgcaactaaatttcttcgatgatggaccgtcaaaatgaacacaaattaacaggtaggcccgacttcggttgggatatgccaaacaagccgttcctcaccattggggaggtggcggacatactgcaagtgagcagccgcaccgtgtataacctgatttacaagggtacgctccgggcttgcaggattacataccacatcacgctaatcaccaaggaggatttcttcctgatgattaaggaaacaacctactgcaagcggagcttttcagtattcgtaaggcaggggaaaaagacaaagaagaaaatgaacggagaaagacaggaaaaagaacaaacagccctcatccgacaagagggaaagaaaaaaacaaagggcagtccgactaaacggcggctcattccggcggcaagctacaagcagtccgtgcgtgacacgttcacggacagggagagtgtcggcggcgacctttatacgatggcggagatatgccaaaagttcaattatacctacgggcggttctacaacctccgtatgcggtactccataccgtgcatcaaagccaattccaccaaatgcttcccgaaagcggaagtggacaaggcgatggcggaagaggacgagcggctgggcaacaacctttcggaacattggtattcgtgctttgacatcatgcggctgttcgggcttggcaagacccaagtccgcaggttcgccctcacgcacggggtacggacgaagcgcatacacggcaaccgcctgtactacctgaaagccgactgggatgcggcacgtaaggaagcggagcggaaaagcgcaagcacgaaagccaaacgggaggaataagcatttataaccaattaaatacacaaccgatatgacaaacatttgtacgaaagtgacggtcaggaaacgacctatcaagaacggacagttatcactttaccttgacttctatccacccgtcaggcacccgaaaacgggcaatttgacaaggcgtgaatatctcggcatctacatttatgccgacccgacagagaagtttgaaacggagttcaacaagaccatgctgcgcaatgcggagcttatcaagtgcaggaggacggaagccatcatcaacgaggagttcggcttcctcgaccgcaacaggggcaaggagagcttcttggaatatttccgctccaaaatggcggacgatgacaatttcaggaattggaacaccgcctacaagcacttcgagaagtattgcggcggaagctgcacctttgatgatttgacggtggaatactgccagggatttctcacctatatgctctcgctcaccacgcaaaacaaaagcaagatgatggcttccaccgccaacaacaacctgaacaagctgaaatgcgtcctgcgccaagcttacgaggaaaggcggattaaggagaacatcgccccacggctgaaacacgcaaaggaagccaatacaaggcgtgagttcctgacgcttgacgaggtgaaaatgcttgccaatacgccctgcgggaagccagtcgtaaggtctgcggctctgttctcctgccttacgggattgcgcatcagcgacatcatacgtctgcaatgggaaaacatcatcagggcggcggacggcggctggtgtatgcacatcgtcaccaaaaagacacggacggaagccattttgccgctgtcggacgaagcccttgccctttgtggcgagcgttccacggggcaggtgttcaagggaatgacacaagccttgctccccttgtacctcaaggattggattaagtcggcaggcattacgaagcacatcacattccattgttttaggcatacctacgcaaccctgcaactcgccgctggcaccgacctttacaccatatcaaagatgcttacacacagcaacgtagcgaccacacaggtttatgccgatgtggtgaacgatctgaagcgaaaggcatccgaacagattacactcaaataaagattacggattatggataaaatcacgtttgaacaactgccgcaggctgtttccctcctgattgaaaaggtggggcagcttgcggacaaggtggacgaggcgttggacaaaggtacgcagcagaaaggcagacggttgcttgccttggatgatgtcgccgccttgctcggcaagtcagcgtccaccatctacgccatgacttccgagaaacgcataccgtaccacaagaggggcaacaaactctacttcttcgaggacgaaatcatcggctggattgaacagggaggaacatcgggaacgggcaacgaggaagagttcaacaggcggcttgaagccttgcgcaacggcaaaaagcacaagccatgttcattacaaataaagtaggcggtatgaggaaagaggacttgatacccgtgatagcacggcacgacccgatattggcaaatgcggtcagccaaatggttgactacatccaagaccgatgggcggcaccgtacccatccaaagaacagacggaagcggtgaacgcctacctccgttccgttcatgcggacggcggcggcacgatgagcgaaaccgacattgcccaccgcaggattgccacgcagaagataaccataaacgccatccgtgtgctcgaccatgaccagctcaaccgcttgcaggatgtgctgaaccacatagcggcggacagggggtattacatgcccgaacagcggcaaggcatgggcaggtagccgaccattgtaacacctaaatatcatagattatggataaggacaaacagaccgtacattactgcaccatcctttcggacgagcagtgggattttattttggagggcaggtcttccgtccaaaggcaaagatgcctgcacaggctgatgacccatgccgtgcggacaaagaccgtttgcaacatcaagggcatagaaatagccttggaggtgggagaagtcgcagcttccgatgtggaacttgcggaatacctgaaatgcaaccgaaagaccatcggcaagctcattgacagctttaacaggctcggtgtgctgaccactcgaacaaacaaccgcacttccatacacaccctgcatttccttacaggctggtatgtcggtggtgtccttctgaccaatccccattatgtcaagccatcggctaatgtcaaagaactggcggacggaaagcggacacctctttccaatgatacggcttcggatggcaagccgtgtgccgtgccgaaaggttgtcaaagtcaaggtcgggaagtggacagcacggagagcaatgcagccaccctttcttcttccctttgttcgtccgtaacttacagccattgggtggacaagccaaacggcgagggtgaaagcgaccacccccacaccatagacggcggtaacagaccgtttgctgactgccccgatgagagccacgcagaagcgcaggacggcacgaatggaggtgcggatgatgccgacacaggcacgggaatttgacgggcgcagagggcggatttcagcggaactcctttgtcgtggtgtgaatgtatgggcttgcccatgtatagcccactataacttctccgcttcgctccaaagttgtgggctctcccgaggggctgggcgttgccccgtcccacttaggacgctgccctaagaacccggcaaggactttcagccctatgcaacccgaccaaagagtgaccctctctttggaaactccgcttagtggcttccacccctaagaacccggagcaggaagtgaccctctccctgctccctccgattaaggctctgccctaataacccaaagtgatactcaaaaacagacaagtcctatggcacagaagacatctatcaacatcaaaccctgcaaccttggaagcagcagcccgcataacaaacggtcagcagaataccttgccaatatccgcaaggagaaattctatatccgcaccgaccttatggaaagaaacgaaatgtgggtatcatcacaattaggcgatacctcattgaccgactactacaatcagatagccgcaatggtcaaggaaaagacaggccgggcgatgcagaccaaagaccgtgaacgggtgaacaaaaagacgggcaaggtgaccatcgtccgtggcagcactccgctcaaggagggtgtggtcgtcatcaaggaggacactacgatggagcagttgcagaagttctgcaaggtgtgtaacgagcgttggggtgtcacagccctgcaagtgttcatccaccgtgacgaggggcattatggaatacccggcgacaatgccacatggaagcccaaccttcacgcccacatcgtatgggattggatgaaccacgaaacgggcaagtcctgcaagctggacgagaaagccatgagcgaaatgcagacggtcttggcagagtgcttggagatggaaaggggcatctctaaggaggttacgggcaaggaacatctggagcgcacggacttcatccttgccaagcagaagcaggaagcggaacgggtcaaagccgaaaaggaagcagcccttgctgccaaggaggaagcggaaacggaactgcagttcatagagggcgagaacaaggcaaaagagcaataccgccaatcgcttgaaagcgagattgccgacaaggagcggcagcttaaagacgagcgcaaggcgaaagtggacagcattttggatggtgttggcaatcttatcggggtgggaaaatccgcagcaatcgaaaaggaaaacgccaagctaaaagccgagaacgagcgcatcaaaaaagcctttcccgatgccgtcaaaatcaaggtagaggaactgacacaggcattggttgcagagaagcagaaagccgaagccgagcgtgacagggctttggtgcaaagccgttcacttggcatggaaaaggacaaggcggtacggcagcttcaggaacagcaagccaatgagctgcaacatatccgtcaagtggtaagccaagccacggcggagaaagacaagaccatccgcttgctgcaaagtgttctgaaagcgagcaggcatattctgaacgtgcttgccgatattctttacaaggcaaacgaagtctttaagcgagccattgatgcgattatccatttcggtacggaacagcaccaatcgttctttgctccatccgaagctgccgacatcaagagcgtgatgcaggagtacggggaaacgaccgaacagcagaatgcggtcggcacatggctctgtgactatgcagagagccgccagccttttgacaaaataaaacatcgccatacactcaaagaggttggcgatgttgcagagggaaaatatgattggaaaatagagaatatacaacaaagattacaaagatgatattgggtcttaaatatcatccaaatcgctttgaattttggcttctacattttgagaatcacgatagcgaatcagcaccataccctcgtaaacccctgaggatttttcaattgaaagttgtatatctccacctgtcacttcccatgcactaccatatacaactgttccttgatggacttctgccattaaagcggtattggaatcagaaagggcaggatttttttcttttgagatggacggtttaccatatttgcgagtatacaaatctttatagtagtcataggtgttaacgagagtgttccattctccactcggctcaaacaaaacaactacagcaaaaacatttttcccatcgtctgtagcagttacacctacagttgcttcacggccagtaaaatcccctgtaaacaaagagatattgttttcttgcccgatagaagtaaaccctttggtttttagtttttgacaaaactcggtcatgcttccttcaataggaatacctttgaaagaaagatgttcttgcgccatcatattaacggcagcaaagaatacggctaaggtaatgaaaatctttttcataattatttaattattgggttattagtttgaattcctcgatagttattttgttaattgaaataagccattcaagataaggaatatcgtctttaatgtcactatattttttccccttatattttccaaaatcaatagttttatctaaaatagacacatccgaatatcgttctatgtccggatataaatgcttgagttcttcaaaatcaactttgaaaaacctatctgttgtttccaaccaatgaagatattggcaatctatcttataaatttcagcaatagtttttcctttatattttccaaacataagagtttcatttgccctatgaatggggaatatttcatcaagcgacacacctggaacatcaatcaaaacccactccccacatccagcacaagggatttcctcatctttgatattggggtaacactcttgcctataagtgtcatcaggtttcccatttacaaagcattttccataagcttttccatatctaccacgaggctctactttttcaaccaaaaaagttctatctcgattagggtcaatgcgcctttcctcacttgcagaccgtgccaatcccaattcgcaccgcttgactaagaacggagttcgcttacctatattgtaataaatattgaatatattgtctttcgggtacatggctattcttttagtaaattccttttttccttatttctaacaaccaaacatcatattctttggacttatataatatgagttgagttagtgcattccctttacccacttgaatagtgccatcggaaaaagcataaagataagatttagaaaaacgctttttgtatattctttttcctgtttttgcatcctttactgtaatttttacaccatcaacgaataaatcacctaaatccgcagattttaattcaaccacgacgtctttataggtttctttttctattatggcaatggctacttccctatctaattctacaccaaatgtaggcttggcactttcactttgcgcaaatgtcacaattgagcaaagaaagaacaaaaaagtaataatagcttttttcataagttcaaatatttaatgatgttactatccacacatatcaaaagcacgaagcgtggcactgcaatgctacgtcttagttcggaggtcctgagaaaaccctgtgtacagatgtagtaatagcagcccacgctatagcgtgagaaccactatgctacccttgtacacaattcagaaatttctcaggtttccgtcctacaagataagcataccgcttcttctttttcgtatgtctttggatgagtcgcctctatccatttacaaaaatagggaatttctatgataagtagccattattaaacgaaaatccacgcttttacactgattttttatccttttgtaccttcattggctcatatattgcttaatatactgatttcagtgagctttcaataattccccgacaattcctttgcggttttgacttcattccgagcagtcatcaggaaagtataaaaatgccttccgttcgttaagtttctgttaaatcttcatctaaaaccaacctttttctttccctctttgcttctcccaaaaacggctttttaaccctgtttctcacagcgattatttttgtaccgatattttcttatatcgctgataatcaattacaaatactctctcatatgtattccacatgaactctgtcgtgcgccagttgtacgagcagggcacagacgtggtgatggtcgatacgggtaacagctacgagggcctttgcgaatacctcggcggcaagtacatttcctataccgaggaaagaccgattaccatgaacccgttccgcatcaaccgggttgaaatgaatgtggagaaaacgggcttcctgaaaaacctcgtactgctcatctggaaaggctcgcagggtacggtcacgaagacggaggaccgcctgatagaacaggtcatcacggagtattacgacacctatttcaacggtttcgacggcttcacgcccctgcaacgggaggatttgcgtaaggggctgctcatcgacgaccgtaaccgtaccgagaagcgggacgaggacgaaggagagcgggccgggcgtatcgagcgcatgatcgacgagatggaacgccgccgtaaggagctaaaagtggaagagctgtcgttcaactcgttctatgagttttccgtgcagcgcatccccgacatctgtaccgagaaccacatttcgggcatcgacatctcgacgtaccgttacatgatgaaggacttctaccggggaggcaatcatgaaaagacgctgaacgagaacatggacagttcactgtttgatgagacgttcatcgtcttcgaaatcgacagtataaaagatgatcctctcctgttccctcttgtcacgctgattatcatggacgtattcttacagaagatgcgtatcaagaagaaccgcaaagtcctggtcatagaggaagcgtggaaggcgattgccagcccgctcatggccgaatacatcaagtttatgtacaagacggcccgtaagttctgggcttcggtcggcgtggtgacacaggagatacaggacatcatcggcagccctatcgtcaaggaagccatcatcaacaactcggacgtggtgatgctgctcgaccagagcaagttccgtgagcggttcgatgaaatcaaggctatcctcggccttactgacgtggactgcaagaagatattcaccatcaaccggctggaaaacaaggaagggcgcagtttcttccgcgaggtgttcatccgccggggaacgaccagcggcgtgtacggtgtagaagaaccaagagaatgttacatgacctacaccacggagcgggcggagaaagaagccttgaaactctataaacgggaactgcggtgcagtcatcaggaagctattgaggcgtactgccgggactggaacgccagcggtatcgggaagtccctgccgttcgcccaaaaggtcaacgaggccgggcaggtattgaaccttcatgtaaaacaataacaatcaaatcattaattacaaaaatggaaaagatagacattagccaaagtgtaaagacacttgagttcgggagcaaatatgaagcccgtatccagcggatattccgtgagttcgacatcaagaccatccgggatttgtgccaatggcccggaaaggacttggtaagggtacgcgacatgggaagaaaaagcattgaggaaatagaggatgttctggaaagatacaatctccggttggggatgctcggtaaggaactggacgaatacgccggcatagaaaattccgtacaggacgaggaagaagaggcgaagtgggaacaacgcaggtacgagatcgccaaggaggtattcatacatcaccgtctggtggcaaattccgccgtatatgaggccgacggactgatacgtgcactaagaggcatgacgcaccgttgacggatatctgtttttaaccggagaggaatccatgatgaaacggctgtcacttatccttatactcctgtcgctcgccgttgtgcagcaggtccacgcgcagtattacagcgtgaactacgacgcacgcacggtggcggcaatggctaccgctttcggtacggaagccgtggcggaaagctattaccgggagcaggtcgatgacattctcaagcactacaatgcggcggaagtggctacggcggggatttttgcctccaagttcttggagcataaagccttttccgacctcggtatctggaatagcagtacagaaaattactactaccgccgcatttaccgcatggtctcggagaaaatcatgccgaagatatgggtggtggcgaaactgatgctccgctcgcctcaaacggctatctactggggcagctacctgatgaaaatctgcgacgagacgaaaagtctgtgtatgcagttcgagagtgtggtgacgaacagcacgctgggcttttcggacatcgtgtttctggaaatcaaccgaaacatcgcccctctgctgaaactctcggaagtgggcgacatcgactggcaacgtatgttggacgatctcgccagcgtgccgggtaactttacgaaagagaacctgcaacacgacatcgacaacctctacaacatgggtgtcggtctcgcctcggctggtatcggaaatatcggtgacgtcctgctgcagaccagttctttccatgatctgatgggcggcagggtcagcaaggtcatcgacctgtatgaccattacggtgcgctcttcgagcaggcggaacatgacctcggaggtctgctgattgatatggtgggcggagaggacaacgtggcgggactgttcgatttcagcaactacgaccttacctcgtggatgacagattatctggacaagacagcgggaaactactacacgcaacggtggtatatcgcccgtcgcgagcaagggagtatcgccctgtgcgattactacccgccgacggacgacaacagcatattgaacggcggagagtggacacgtttcgagacgaccgatcccggcttctatcccaatgcctcgcaacgggagcaggttctcgccaattcggaacggtacgccggttggtcgagaagccgggttcagctgctcaacagtcagaacgacggctatacctacaccatcgactactggcagaacggttacatcatcagtcggggcggcaaacagacgaagaaagcctatgcctatgaaatccatgtgaagaaaagctggaaccgggaggaaatcatttacgaggaggtgttcgattcctattcgatggacctgaacacgttcaaggcgcaactcaatgcccgcctcttggagttcaacgacaacgaggagggttatacttactatatcgcatccgatgcgcggaactactatcaggcgacggacgctgcgaagttgcagggctgcgagagcgtgaccatcagcgtaacctgctcggacggggctacgcttggtcagggcacgacgcagtacaagtgcagaaagtgcggcaaatccctgaacgcccattcaaaggagtgtgccatgcagaccacggttacggagaacgaattggacttgtccgagttggacgccatgctgcaggaggcggagaaccaggtggccgcccttcagtcgcaaatcaatgcgttggagaatgagaatgccgacctgctgaaaaaaatcgccgaggcgagcgtggaagatgcggcggtgtaccgacagcagtacaatgcgaacaaaacacagatagaccgcctgaaaagcgagctgtccgaatggcagaagaaacaacgggaatacaccgacgcaaaagccgaggcggcgggcgataacgatgtggcaacggacgactattaccgcataccggccatcatgcaggactgtaagacggcttacagcctgtcatggcaggacggcggggcgtggaacggctacacctatgtccgtaaggcgaccatgccgaacatcaacggggtcatcacgttcaaggcgacggtctcgatagcccgcaaaccgaaatatttcctcggtatcaagatacaccgtgccatcgtgcagatcagttgggaactgaccacggaatataccgacacgtatgtagccgacgtgctgacactcgacccgaacctgtcggacgcggagaaaacgaaactggtgaacgaccgtattgcggagattgcacgggaacacccttcgtgcaagatcacgacggaatacgcccgtaccccgccattggaagagactccgaccggggaggtgtaccatctgctgtggtcgagcgaccggctcgaaatcgcacgggaagtggattcccggattacaaaaatatatgcagacctcgtgtcgctggaaaagatgatgcactataagcggagcatcatcgacgtgctgaaggatgtgctgcccgaactggacatggacgagggacgcaggctgacgctcgtggaggaatgccacgaacgttgggtggagaatgcgcgaaacctgcggaacggaaacggcaaagacagcggaaaggaggtgcggccatgaaacgtgccctgctgatgacagtcgtgctgctggttctcctgcccggcatcgccaaggcgcaatggaccttcgacatcgtgtcagtggaagcctacatcaacgaccacaagaaacagcggagcctgctgctggcccgcagtacgctggaatacagcaacaagctgctgcacgaatacagccgcaaggagatcggcgagtacaaggaactgaatgtggacttggatcgctacacccgtgccttcgatgtcatcgacgtgatgtaccagtccttgcggacggtactgaacgtgaaaagcacttatacggcggtcagcgaccgtatcggcgattacaagaaactgttggaggacttcaacgagagaatcgtgaaacggggacgcatcgaccccggcgatgccgtgatactggccatcaacgaaaaggcaatacgggacatcgccaatgacggggagcagctctacaagtcggtgagcgaccttgtgctgtatgccaccggggcggcggcctgctcgacctccgacctgctgctggtactggaagcggtgaacacgtcgctggacgacatcgagcgacacctgaaccgggcgtatatcgagacatggcggtacatacaggtgcgtatcggttactggaaagcgaagatttaccgtcccaaggtcaaggagattatcgacggagctttcggacgatggcgcaaagcgggacggctggattattaatgaacgatgaaagggaaagaagacagactatctacaggttggagtttgacttccatgccatcgacatcgggaaataaaaacagagaaagaatttttagtacgaacaagcctattgggattataaccaagggataaagagacatttagattgatgcaatggaaaagattgtttttgcaaaagacattacgttatataaagccgactgtcttgaagtaatgccttttcttccggaatcaagtatcgacttggttttatgtgatcccccctttggaatcacagcttcacagtgggataaaataataccattcccggaaatgtggaaagagatcaggagagtcaggaaagaaaatgcacctacggtcttatttggcagcgaaccgttcagcagccttctacgctgcggtaatttagaggaatttaaatatgactgggtttgggaaaagtcaaaagcaagcaattttcttctcgctaaaaaacaacctctaaaagcacatgagctaataagtgtctttggtaaaggtagaatcccttattatcccatcatggaggaaggtgagccttacgggaatcgcacgaagagaggaagcaattggacaggaataaacaatgtccccaatcctacattcagaaatgaaaacaaagggacaaggtatccacgaagtgtgatatacttcaaaacagcggaatcggaaggcaaaacgattcatgtcaaccaaaagccgattgcattattgcagtatctgataagaacatacacaaaggaaggagatactgtccttgattttgcatcggggagcatgagcaccgcaattgcctgtatctatacgcatagaaaatgtatttgcattgaaaaagacgagacgcatttctcgcagggagagaaacgagtcaggaatgagtaccaatatttacggctttgaagcaggccctcaaagtatgactatacgatataaataactgtaaaataatgaataaccggaaattaatatgaacagaactctcttactcatggcggttgcagcagttgcaacgagcggtgtcaaggcgcagtcggttacttacaaccatgactcgccgaaacagaaccagattacggtcatggaaaccggtacgggcgctctgtcgcccgaactttactacacgctgctgcataacaagtacaagaagtcggcggcaagcaagaacaaactgtcgttccgcacgctggcgggtgtcaatctctacaatcagacagatgaagcggaagccattgactcggctctggtcaaacgtgccgaaatcgaggcgctgaacgtggccgaccggcagattgacctcgcatggctggccgagggcgataagataaacgctcaaatggagcggtttcagcgcaacatagaccggattctccttgccgggggcacgacggacgacaaggagcggtggacggaatactatcatgtgtaccagtgtgccatcgacgcaacgaaggacgcttatatgcccaatgcgcaacgaaagaaagaatacctgcggatctacgaagacgtggtacggcagaacgagattctggtcggctaccttgcccgaagacagaacgccacggccacggacggattgctgaacgtaaccgccgaccgaaccttggacaaaagcagcgtcgtcagaaacgccatgagccgctggaacgaatcgcgccttgcggtgcgaggttcacagtcggacggcggcattggaacgggtgacggagacgagacggtaaacagagggaactaaaagcatataacctatggcagacggaaatattctttcggatttcggtatcgacctcttggaagaggagatcgacgacgtgatttttcagaccaacgagttcctgaccgacgcgacctttaccggctcgcaaggtccattttggtggatattgcagatgtgcatggcgctggccgccctgttcgctatcgtcatggcggcaggcatggcgtacaaaatgatggtcaagcacgagcctttggacgtgatgaagctcttcagaccgctggccgtgtcgctcattctctgctggtggtatcctccggcagacacgggcatggcaaacagcgggagcaactggtgctttttagatttcctctcctatatcccgaactgcgtcggttcgtacacacatgacctgtacgaggccgaagcctcgcaaatctcggacaagttcgagaaagtgcaggagttgatttacgtgcgcgacacgatgtacactgccctgcaggcacaagccgatgtcgcccacacgggtacgtccgatcccaaccttatcgaggcaacgatggaacaaactggcgtggacgaggttacgaacatggagaaggatgcagcgaagctgtggttcacgtcgctgacatcgggtgtcatcgtgggaatagacaaaatcatcatacttatcgccttggtggtgttccgtatcggttggtgggcgactaaccaattccattctttaactatctaattattagatgagttttattggaaattcaaaagaaaggtaacaaatgagtatcaaatagtggttttatttgaaagttggcacagaacgcacatgtttttcgatgcggaatgattactcatttggatttacttacacatcattgcgtttgcgaagttacgggatttttccgaattattcaatacggaatggcatgattagcgttacatgcttaaagagcatttttatagttcgatattattataaacatgacaaactccctcttcaattaagaaaagagagtttgtcattgtaaaccttatgtatataaaaatcaatttttatatcctctttcagggtttcttacggacagcccgtacagaaagttccctactacgcaatttggaagaggttgagccatcgctgtgtttataggcgtactggttgtcatcctttacagccgtagaagtccaatattcaccctccaaaggatattccgtatcatttattcctgctacctcttctgttgcgggaagataccacttcgggtccataacttccgagccgcccgtcaacgaaaggatatattcattatttgcttcgataatatcccaactgttcagtttcatacaagctatacttgcattattcgtagggaacacacccttaccttctgttgcaacctgataaccggggatattttgtatccggttgattatctcattcacaaactgaataccgttgaagttatacacttcccgcgtatttttttgcccatccgtcatactctcggcaacaccggaagtcgagagagaaccgaggttgatcgttatcttatcagctttcccccctaagccgataaaatcaccggatttctccatatcaacgaaagacaaatcgggaatatcatcaccaaaaatcgcatgaatcagccaacccaacaaccatgaatcgcccaatgcctttaatgccttagtccactctacatattgtctgatactttcacgagaatcattatcgcaactggtcaaatcatagattaacttgaaatcactgtcccaagaaaatccccaaggaaccttttctccttctatccgttcgcaaccaataccattgccataccaagcgggagcaagctgggaaatggtcaatgtctgtactatgtcatcgctatcgtcaagccgtacagacaactctactgtacgtgaggcatctcctatattctccggcacaaaaactgcaataggaaattcgccgcttcccgtaccttgataaactgtctcgcctcgtgcgctaccggtaatttcgagtttaccacttgttgttccatgtgcataattggccgtccaataaccttgcttggcatagctgttcatgttgtcttgtttctgaatagtgaccttttcatcattcagggttggagcagtaaccgtccatgtcttacctgccggaacatcggacacgatcagttttgttaaaagaatgtcgtaatgtgcgtctaatacaggattttcattttccaacttaaactcgtattccggcgaaatggacaatttgtaagtaaccgttttcccttgaggccattccattcctgcaacgggggcttcgagagtgcgattttcacctgttactccatcggcgaacaccacttccaccttcgcacctgtcggcaaggtttgcggtagcatcatgaacgtgccttctcctgcggagacttccgttccgtctgtctcgtttccgctcatctttttatccaatgattgtgtaaagtcattagcatcatcattcaacgtccattttccgttttccaagtcgtaggaacctttatatcgaactcctttcagggctacgcttttaatcgttccgggctgcatttgactgccggtcacaaaacgaacggctgtgcaaatatgctcgaaagcaagcggtatcacttcgttcttatttccttcgatttcgtccgttttcgccaccacaaggtctttttgttcactcacagctgcaggaacagtgtatgtcagcgtcgtgttacccggtgcttcgggaatagctaattcggcgtcaattggtgcccaagcgaaaaattgcagggtgcgtgtcgctcccggccagtaatacacgttgtctgtgctccaattattgttccggtaagttacgttgtcatccatgtagaacgtgttgaccagtgtgccgtcttccttgcaatgggcctgtacatggaaagtgccgtattcttcgagcgagttgacgggagccgagcgtgtcaccggtgtttctccggagaaagaggagcagtcgataccatcggaaaccgtagcacggacacaaagtgtgtccggcgtattcgcactccgcaacacgaaacgtccggtggtgtgttcttcctttaccttacctgtgccgacaattcctcttgtcaaagggctttccgtcccggatatgtcgaaacaaatgtggtcgctatatttcccgatgttactatcgctgtcattatcgagaaagtcatcgttgttacacgaaaataacaagagactggtgagcagtaccgtcatcctgcctgttatcaagtaccgatttttatatgctttcatatcttttgatttttcaattatgccgtgaaagttctttgcggcggctattcgtgagtataaggggaacattcaaccccttataccctaaagatattttacgtgggtgactgtcgtgccaccccgtaaaacatcttttcggctttccggtatattccctaacggacaaatccggatgattattcaacaggttcaaccggaagttctgttgcaggggtgttgaaatcttcccatttatcaaccgttgctgagaacttaatctcacagagttgggtatccgggtcaatgtttttagcttcgagtttcgcaacaaaggcataactgtttccggctgcccagtctacagaaggaatggatacttcatggtcatactcgtctgtcacaccgtgatgagtacgtataactttgaattgcacggtataggtctgttcttcgcccatgaccggaatcatgtacttgtggtcggtttcttttgtctcagcagctgcaaaaccggttgcctcgccgtccaataccacgttgccaaaattcagtgaagccggggtattatcagcagccaaagtccatgttacattttcgtccaaagcagcagtcgcctttacattggcattcgtgatttttacaccggtaacattgatgacagaaccatcatccattccattttggaaagcaaatttcacacgggacaacatgtggttgagtgtgaaattaattgcagcaggacattgtttgttcatgactacaggagaagaggcatacgtatcgtcaatatcgtaaatcaggtcggtagtaccatcgccgttattaaaagcaatgcttccccactgaccaacagtagtcggggcagtgaatgtccagttatcaccggtcgctttgggggctacggctacgaaactatatttgtagccatcttcccaataaacgggtgtcgtgtaactccactcactaccgtcggaacttgtaacctcagtaccttcaaacggcttaccagtctgaccgtccttttccatcaagccccatacctgaaaggctttgaaattggagttgtcgatgtcagtggctcgtgtcgttttgtttacgaaactgctaaactggatagcctgactgttacgggctatatccatagtctcatcattgctgcaacttgccaacattgcggcggcagcaattcccacaaaaaaaagattttttttcatgtcgctaaatttttttagtgaaacaaataaattaataaatacattcaatcttttagagagggagttcgatgtcttcgtactcaccccaatcttttaccgtcacatcgaatccggaaccgccttccgtaccttcctcgtcggaaatctcgataccgctcaccacaataacccctccctgcggctgtacggcgacctgatcggtcacgtcgaaatcgaacgacttgactttcccgttcttcaggcgcacttcaagattcagcccgtaacggcgttcggtacgtgtcgtgtagtgttcgttcgggtagtccggtatgccgaacgactggacgcaggcctgtgttccgaaatcttccacgctacaatcatataatatggtagctgcctcttccgaggtgcgtccgctgttcagccataccgcaccggccatgcctgccaatgcgccgcgtgccaacgccacgtattccaacccgtggctgaactcgtaacgcaccagataggtaaaaaccaacgggtgcatggtcacgggcagttcgtcggcctcaatcttgcgttcggccgtgtagttctccatgtagttgccataaagcatatcgggagcattcaccgtgttttcgacggtattttccatgtacggattgcccgcatacgacgcacgggtacgtgtacgggtcgtggcctttgccgatgcgaacgagttcatgtcgtcaaagacgatgtattccgtgtcgttgttgtagagcagcagggagtgttctcccggacgcatccgcacgatgtcgccttcgggtgccacgttcaggatgttgttggtgccgtcctcgttatatacctgcacgcgcaacccgtcgggagcgtcggggcatagctcatggtactccataccgaacctgctctcccatgcggggtattgctcccagtcgggacctccctcgcaagtatgttcccattccttttcgtacactgccttcacgtgcacgtctgacttcggggcgtgtgcctcatggtcgaaacataagtccttgtgttcgcaggaagaaaacaccgtcagcattcctgccaacagggaaacgtatcttatcgtgtatctcatcatttcatacctcctttcctgttattgctgttgccccgtccgagcagccagaccaaagatatttccgccttggtcggcccgaaccagtggcggttcttggtggattcccacacgtcatgcccatcgagagggctgtaggtataatatttgccgccccagtagcccacgccgatagtgaaatctatgttcagcctgcgtgccaccggcagggagtagccgtattccacgcccacggcatagttgcccttgtcccaaagtgtccctccgggttcgcctcccatgtagccggtgcctccccactcgaagtcgtatgtgaacacctgcccgtaaacgcccagatgatgcccggtgagcggcttcccggcagcacgttttcccagccacttgcgcacggcgatgtcgccgccgtacacacgccaatagcggtgcttgctgcccttgtcccaccagccgtacatccagtttccgccgagcgtccatcccttgccgagatagaactcgacgccgatgttgggcacggccaagacgtcataaagcatgtttgtcttgacggccatgtagaaaggtttccgttcttcctgctccggtacgatagcctgcggtacgagcgtgtccgtttcctgaataacggcagccgtatcaatggcgggaaccgtctgtaattcgaccgtatcgctttttattaccggcttttgccgtaccgtcacgaatacgacgctggcgttgcgaacctgcgggaagaaatgttccagcatatagaaccaagtgcgcccgtactgcagttccatcaaatgttttttcttgctgtcaatcagaacccctttgtcattgtacgtgtattcggggacattgcgcagcacctccacggcttcctccttgtgaggcatgtccgactgttccgccagacaggccagacgttcccaagcgatggtggcatcgcaacgggtgacgatactgtccggaagcgaaatacatctgcgcacatagttctccactgccgcacggcgttcttccgccagccttcgattgattccggcagacccttccggtgaagcagaaccacagaaggacacctcgaccagatcgagtgccccatcatttttaacacttcccaaaaacgatacgatttccgccagacgctcggcgttatttacataggctgtgtccagcgtgctcttgccgacacggaaatccacacagatttccttccggctttcctgtccgaaaagatgaacgctcccgaacagagtgaataccaatactataaaactttttgtccgcatttcaattcccttttttatccccctcttaccaagagagggataaaaagaataatgcactaacaatcagtatatttcgttggggtgaaattgaaatttgctaaacatttatgtgtttttgaacatagaagtaacattttttatagaaaaaattctttgctatacattcttttttatacttttgcatcgtctaatccctctcttggtaagaggtaacattttttgcctgacattctaccttaattttttcaatatcagatcattcgctttgtctatcgttgaattgtccaaagaggcaagatatatttgcgtggtattttccgaatcatgccccatacccgcactgatgaccgacaggggaatgttctgacttttagcgatactggcccatgaatggcggctgacgtacatcgtgagtttggcttgtaggccgattgatacggatatttccttgagcttgttgttgaccagacggagcgcatttctgtactgcaaccgttcgttccggtctgtcttgatgattggcagcaaatagccgttttcatttgccgggtatttgtcgataatctcctgcatggatttttcccacttgatgaataattgctgccccgtctttcgtctgcgataggaaaggatgccgttctgcaaatccttcttcttgagatatgccatgtcgatgaacgacattccgcgtgtgtaaaatgagaacagaaacatgtcccttgcaaaatccaatgaggacttgagcgacaggtccagttccttaatccgtctgatgattttcaagggaagagcacgcttgaccgttttgtctattcctgtatagacatgcttgaaaggataccgttgcacggtcatttccttttccaccgcacggttgtacacggcacggagaatccggttataaaaggaaacggtgttcatggctacgtcgtgggatttcaaataggcttcgtattccgtcatcaggtctgaatcaatttcattcagcatgatgtcgttcccgttccgaaagcgtttgaagctattaagggctgtcgtgtaattttccgcagtccgttcctttcccaatcgttccagttgaagaatgacctccgccataaactcgaaaaaggacgcttcccgttccgtttcatgaaacagtctcactatctcgtcggtagcaaatgcacgcttgccgctgtttaatccgtttataatcttgtccagccggttcatatcccggcgtatcctttgtgcaacagcctgaataacggctgtccgttcgccctccggtgtcgcaaccggtcttgaccgtttatcatcccattcatgggggaacaccttataaccggttgtgatttgcctgacgacacggcggtgagttacaaaataaacgatagtgcccggacggccttcgactgtcgacgggcggaatttcacttttactgttgtcatacttatatttatttaattgataatgtttcattgtcttaacttgcggcatataaaaatggtcagcacgatacagagtacaagaaaacctgccgtatagccaagtattttccacagcattagactgtgtatgaactggctgtttgccatgcaggtacagacaaaagccgccgcgagggagatgattgcctctaccatacaccagaaagcggttgcggagataagcacacggtcattcgccgagaggcgtccggccagccttgcgcactcccgttccatcctgtcggccatcttccggcagattttctccccttcctgctcaagcgtctttctcgcttcctcgccgactgtgaccgtgctcgccccacgcagggaagaaacagccccgtccattttgggcagggcttccgaaagtctgttttcaagcttttccacattagcactaagaatgcgtacagcttcataattgttttccagcgcgttgattatatgctcttgctcctgcatcttttcggcagccggaagggcctcgtctatttccgagaaatcgaattttttattcataggctgttatctttttcgtcctgtcctcggtttctttccgatcacccttgccgcttcacgggcgcaccggcgtgcccattcccgttcgtcctcgtcctcgcgtcttccccaaggcaggtcgttggaactgccgccaccacctcccgaaggaaccgccggagtatcgagcatcccgacgaaaagtgccgctgccatgtccgtgaggtcacggctgttggctgtctcccggtagtcgaactcgtcattgaatacgtccaacgcttcatcgggaatgaagaaccggcggctttccccgtcgatgtcgatatggtacgggctggtaccgggacgatagccggtgtattgcggaaccggtgccgttccttgtgcgtgaaccggaatcgtccgagatgtagtcggtatagatttccctgcggcgggctgtgtcgaaacagtccttgtcttgggagccgcgtgcagctttttccacgtgctttcgagcttggtcgccatgaggttgcgccccctgccgagttcggaagccttgtatctggcgttgcctttcttcagcacgtaaccgcgcaatatcttcttgttgtcgcgcagctcccaaaactcatatcccttgctcctaagtctggccacgtactcgtcccatgaccagctttccatggattgcagggtttccatgcagtcccggttcacctgcccgatgttcgtctcacgtacttcggcggcagtcgtccagccccgtttcagggccacacgctcggctgcccgctgtgcccgcaggtgtatgtcatggtcgttgttgatattccccctttcgtcgatacggcagaacgcgccgtgaaggtggggaatgccgctcttggattccagatgcagccacaccgtgcccttgctgcctttgaggtcggttttcggagaataggtcttgccgttcttgtcaagcagttcgatgttgtcgaactcatccgtgaagtcgtcccacaacctttgccagtcgtcaatggtaaagtctttggtgtgttccggcgcggggctgacctcgatgcggatgacggaatttttgacccgtttggacttctccagcgtcagccgcatggaatcccatatacccgtggcatccagaccgggcggcagaagattgtcccccacgtggaagatgcgttcgggatgtttcttgttcctcgattctcccgtgatgtatctgatgtcatttatcccgtgggagatggatttcgctttccctatcatggctcgtcctccccgtcttcaccgttccttgtcccgtcgggcaagcggttggaaaaccgtaccttgtcgagcacgtccgtgacacgctcggccagcctgccgagttccttgagccattcgagcatgaaagggtaactgttaaacatctgtctgcgcttttcggggttcatgccacggagcgcggacgtgtagttcacgaggtcgctgcggcatcctataagggtctccatgactgcctcctgccttgccgtcagcctcgctttcggtctgtaattgaaagcccttgccagcacgtagctgctgacggtcatgccgcactcggcggcgaggcggcggatgtactgtttctgttccgcggtgactttggcgccgatgtattcggtgcggctgccgccggacggaaatgatgtgtcttgcttgttgtcttctgtcataaatgttgttttataagggttaagcggtgcgagcctgcgagcgccgccaccggcgaactgccagtgagccgcgagagcgccaagggatgactgaccgaagggaggtgataccttggcatatctcgaaactgaaagacgttttcagttctcctgcggcgtgcctccgctgccggataaaatgccattcaaaggccgttcaaatgccattcagggcgggattgcaaaggtttatgacgcggcggttctgaaagtccgtccattcctcgatacaggtcatggaagcgacggaagcggttttggaagcgtccaccgctatcatgcccagcctttccatcgttgcaaggagattgcgggttctttttctccctacgttccattcctccgcgagtctggtttccgagaactggaactgtccgggctgcaattcctgcggcctgcggaatgaatcgcccctgccgggtgacagtcgcatccgtgagagcaggtcataaaaaagagtgtggttgccgattctattgccgtcgtcatctttcgttgtccttccgagccattcgattgcctccgcagtaagacggatgcggattgtacggaatccctgcggcttcttgaaaagggatgtttccttgttcctcttgttttcttgcataatttaataaaaaataagggaatggagtatcggaaaacctacaacagtttcaatgagatagtgcgtgcgggagtttccttgtccgtccgataccccgttccggtttgacgtcagttccggttcacgttggcggcgggttgggattgcaggtgcccccgtgcgtcctccaccgccttgaagtcggaagagattttcatcagtgcgacgctgacgcggcagagctggccgatgtcgacaaaatccttgacggcttccatcagtttttgcgcacgttcctgacggtgtttcatcacggcctcgccatctgtcccgttttccttggtaagcccgtggttgagaaagcggttgacggtcagcatgtctgtcgcctcaatcgttgcggtatcgccattgcccgttccgtagccgaccattacccgtatggaatctgcctcgtagggggtacagccgcgaaggaagtccagaatggtctgcgccttcgcgctgattgcgggtctgctctctttctttctctgttccttgttcggggaatcctgaaccgcgatattcctgatacccggttccatgttctttgaattgtccatgactgcattgttctaaaaaaggttgatgaatcatttgtctttctcacgtgccaccagatagcgggatgcctcgctgtcgatctcggcctgcgacttcacccgtacccgtttcagccatgcgtcgaggtcttccttggcgaagaagcacagcttgccgcccggtttgtaataagggattgcgcggcgcatcatcatcttgtagagatagctgggcttcagtccgaggtagcgggctgcttccgtggtggtcattaaattgcgttcactttccatatacgttcatttttattgttacttgtacttttgtagaatcgaaatctgctgtttttcagacttttcctttcttctgtttccgatgcaaagttaagtttgccccaaggtgggccaatgggggacgaatggggaaagtgtataaaaagaaaatgcgccataccgttgtgtatgaacggtatagcgcatggctataatggggagataccgggctgaatggggaaacggcgggcggttatggggtgcctttcagccgtcttgcgttttcaacggccctgtcgatggatttgcggaaatcttggttctcttttgtagcacctttgttgcaaacgtcgctgcggtgcttgtcgtagtaggatttggatatgccgcagcgtttcaggaactcttccgaccagagtttcccgcgctcgcgcggcctgatggtacgggcgatggaaaacaccatgtaacagatgcgcaggttctctttcgggcgcacgatgaccgcccgtccggtgggtttcaggttcaggaagttcacgaagtcgctgcccgacaggtactcgaactggtagtcgttgcacacctcgtagatgaacaggcacagggcgaggtcaacggtgtccatccatgcggcggtctcttgcagcaggcttgcacggttcatggtttcccctccttcatgcgtccgatgtcggagatgatgcttccggcgataccctgcagacgctccaccagcacgtcgaggaacatcggtttgaaacaccagacacagaaattccggtcacgctcctgcacccattctttatataatagattcgcgtgcgcgtgggccacgtcatactttgcctttgccgcaccgcattccgcatcgagcgacctgtattcttccgaatccagaggcaggaaatccagccggctgctcatcgccgaatattcgctccataattttgtggcgcttgctttcgcttcctcgtaccggagttcaagcggtttgaggtgttccctgaaaagggtttcaaagtccgccacctgcaacggcgtcctgtcgagtgaaaggtatttgttcgtttccgaaagaagggaagaggaaaagtccagaagttgtccggggttttcctttaccagacaggcagcctccttgacaagaaggttcgtgtcgttgaaatcctgatagaacagggacggaggcaagacctgttcaaaagacaaaacaccttgtccgtaagtggcaagaagtgtgttcacttcgtgcaaccgttgtgttatttgccgtatcatcatagtcgtcaggaattgaaaaggtcgtccatcgtcacctcgctgtggacgatgcttctgttcttgccattggccacgccatacgtcgtgataaaggtatgaaccaatgtcttgttggtcttggtaagttccctgaacaaaccggaacggtcacgcaaccggcgttcgtattcgggcttgatacggtatgtgtccatgcagaatttcatctcgcacaggtgtatgatccggtcagcccgctctattatcatgtctatttgtccgccgggcattccttcctccttgttgggcttgacctgccatgtggacaaggatgtagccatgccccttattcccaaagccgacttgatctgtttatgatgtctcatgcagacaagctcgaaactgctgcccatccagtcgaatacatttccggaatcaagatgattgctccaccattcatcatcgtgtgagaggttgtcggcaaggaacttgaaatagaacagcgaaaagaaatccgtaagcctgtaaacggctccgcgacgtttgttgccgtactgaagccatttctctatcatatcggacctttcaaggttttttatcgccttggttatgttgctgctcttcgatgatagtgactggaatatgtccttgcttgtcattcccgattcgtgttcgctgagtagttgcacgattgacgtgtacaggtcggcattgtcgaaaagggcgttgtatagctcctcgaactccagtttcaaaagtgcgccttcattgaaaaacagccggtctatattctgggaaaggctcaacgtggggtcaagaaggctgtaataaaacggaacaccgccaagcaccatgtatgtctgggtaagctggtaacggtcccattcgatgcctctggttgcgagataccgctccgtctcattcagggtaaacggggacagatgcaggttacacgtcactctggcatggaggcctcccttgttggcgacaatcttgtctttcatccatgaggtcgcggaccccgtggcgataagcatgatgttccgctgtgacatggcccagccgttccagaagttttcaagggccgacacgaatatggattttcccgaatccatccaaggcatttcatctatgaacacaatccgtttacggtcagcgggcagggacgacaggtattcttcaagggcataaaaggcttcatcccagttgcttaaatgggagaactttttttccgaataactgttgagcacattcaggaagttgttcaactgtctgcgggtggtcattccatgcgcaccgacatatttgaaatcaaacttccggtcgaaaaattcttcaatcaggaatgtctttccgatacgccgcctgccgtagactatgaccagctccgatctgtccgagttcaggcatctttccagttccgcgtgttctttgtcgcggccaataagtttatccatactttcatgttttgatgcaaaattacgcatttggaattgcccaagcaaattttagaaccacttatttgaaattatctacaaaatattacgctgtaaattcagatataaggttttgtgaggtttatgagctgcgtccataaatctgaaattatctatctcaatcaagaagattagttcaggtttatgtatctgataaacagatatgccgagttttgacctcttcggattgaaatctgacagggaaggtcaaaattcggcaattattcaaataggattggaaccggtggtaatggagtacaacgcaggatgtcagccaaatacgttatcaaccagattcaccgcttcaactttcttgctgtcaacgattttcgcgtatatctgcgtggtctttacgttggcgtggccgagcagtttgctcgtggtataaaggtccgctccgagggtaagcatcatcgtggcgaacgtgtggcgggcctgatgataggtgatttttttattgattcctgccgttgccatccatttggccagtaccttgttgatattgggttctgccgggagtccggcaaagacatgcagcccgtcttccgcaccgttcctttcaggcagccaacggacggcatggcgggaaagaggcaagtaaatcggtgtggtagttttttgcatcacggttgacatccggtattgttccccgtcctgaacaatatctttccatcgtaaggcatagacatcgctcaacctcaaaccgcagtaacaggcgaaaaggtaggcacgtttcacgtcttcacgggggcattccgtgtcgatcagaattttaatctcgtcaatggtcaggtattcccgtttggattccggcaccttgatacgttctgtggctgcaagtgtcattatcgggttctccgggataacttcggcacggacggcggcgttgagtgccgtggaaaaatagcccacgtagtccgctgcgcttttgggtgaaagcggcttgtcccaccgggtcttgtaggtgtgctgaatccagtcgatgaaacccagacaccagtccttgtcaatctctctcatcctcacctttttcttgtaaaggggaagcaaccggcagactgtccgtaacagtttcagtcctctcgcgccttttcgttcctgttcggcaagataggtttccatccagtcgtccagcagcattttggaacggacggatgtctttttcagtccggccttcgagtgggtcagttcgatgatgcgttttgatttgatggcttctaccgccgcttttgtggcacggttctgctccttgaccataggattgatttcgggcaacaggtatagtttcaagaactcgtaactgcgttttccgtcaacatagatgtcgagataataggattccgaaccgtcggcgagcttcttcgtgcgcacctttaccggttccttgagtctggttgatttccttgttgttgccatatataataatgtatttagaatgcgtcgtcaaccaaggcgattgcatcgtcctttttcttgtctactattttcgcataaacctgtgtggcacgcacggaacggtggccgaggattttggaaacggtatagatgtccgctccgagcgtcagcagcagcaccgcgcatgaatgacgtgccgtgtgaaatgtcacgttcttctttacgcctgccttatcagcccagttcttgagactgacacaaaggttgcttgtattgggcaaccctccaaagacaaggccatccggtgtgcagccattacgttccggcaaccattttaccgcttggggcgaaagggggatataaacgggattcgtggtctttgtcataactacagacacgagccattgcccgcctgatgtggagatgtcacgccagcgcaatttccgtatgtcactgatacgaagtccacaaaaacaggaaaacaggtatgcctgccgtacctgctcgttaaagaatggcgtggctatcattttctttatctcctcgatggtcagaaaatcccgtttgctttcgggaactttgattttctcggtcatctccagtttgtaccaaggatttgattcaatcagtctttcacgcacagcctcgttcaaagcggtacgcaaagtggtataataggaatgggccgtcttgggagtaacctgttttccccatgcggtcttgcaggaagagcgaagccagtcgatataatcaaggtagaactgtctgtccacatcacggagcctgacatctgcacggaatttcagcaggttcttgcgggcgttgtcaattccgttcaggtcgcgtgctccccggtgttcgtggttcttgcggacaatggccatccagtcggacagcagcatatcggaagatttgctttccggtactgtttccaccttcgcattgagcagggcttctgtccgttctcgctggatatcttccgccttgcggagtgtctgcgcgttttgccgctttgctttggcggatgtttccggcatgaggtagagttgcagaaactcgtactcatgcccgccgtctacgctacggtcaagaaacagggataaacgtccgtccgccagtttgcggtgacgtaacttgaacggagatttctctattaatgatttcttttttcttcccattgtatatcagcgatttatatccatatacaaagataacaaataatccggatataagtatcgttttaggtaacaaaaatgtcgaataatagagatttttaaggaatacaacagaaatcatcattacttaataatacattgataatcaatatttatatagattttatttgtttttattttcccttcgtttcaatacattggctaatgggcgacgatttactgccagcaaattcttttgggaatgctcaccattttcggacctatccagtgggcgttttcgctcctgcccaaatgggaaggcgcatgggcgaagtggctcacgaggtatctgacggtgcatttctacggggcgatgctctacttcgtgggcttctacgtactgctgctgttcgacatcgtgctctgcatacaggtggagaacctgacggcgataacgacaagcgagcagacgatggcagcttacctgcaaaactccttcttctcggcgggctatctgatggcggcaagcatcgtggccctaaaatgcctgaacctcgtccccgaccttgcggcatggatgataccggagggtgacacggcgttctcaacccgaaacttcggcgagggcgtggcgcagcaggctaaaatgacggcaacaggcgcaatgggtacggtaatgagataacaaagtaacgataaatattcaaacaaaatggtcatcaagaatttagagaacaaaatcaaactggtcggaattatttgcaccgcctttcttgtgggctgcgtcatcatcagcgtgtcgagtatctggacggcccgcacgatggttacggacgctcaaaagaaagtgtatgtgctggacggcaacgtgcccatactggtacgccgcacgacaatggaggaaacgctcgacgtggaagccaagagccatgtcgaaatgttccaccactacttctttacccttgctcccgacgacaagtacatccgctacacgatggagaaagcgatgtacttagtggacgaaacgggcttggcgcagtacaatacgctcaaggagaaaggcttctattccaacatcttgggaacgagtgccgtcttttcgattttctgcgacagtatcaccttcaacaaggagaagatggagttcacttactacgggcggcagcgtatcgaacggcgcagcaatatcctgatgcgcgaactggttacggcgggacagctcaagcgtgtaccccggacggagaacaacccgcacgggctgctcatcgtgaactggcgcacgctgctgaacaaggacatcgagcaaaagacaaaaagcaactattaactctaccagccctatgaatatcaaaggattcagacgtatgctgttcggcgagaagatgccggacaaaaacgacccgaaatacaaggagcgctacgaacgcgacgtggatgccgggcgacgcttcgccaaagcgacacgtatcgacaaggcagtggccaaagtacagggtttcgccaacgcccaccggacgctgtttctcgtcatcgtattcggcttcgccatctgcgggctgacatggaatatttaccgcctgacggtggtgtactgccatcatccagtccgccgaacggccacggaaatgcaggattccgtgctccgggaacggcataagatgctttccgtaccgcatgtacgaagattcgatacgaaggaaagcggtacggaaaggccggaatagaacggcaggcttatgaatatgccgtttgagagaactataagcaagtatgtgcaactcaattaaagggaaacaatgaacaatatcttcaagagaatcaatttcaggcagccgaagtatatgcttccggctatcctctatatcccccttctcggcacgtcgtacttcattttcgacctgttccataccgagaaggccgaggtacaggacaagacactccagacgaccgagttcctgaatcccgaattgccggacgcccaaatcaagggcggcgacggtatcggcagcaagtatgagaacatggccaaatcatggggcaagatacaagattattccgctgtggacaacatcgagcgggacgaaccggacgataaccaagaggaatatgaatcgcaatacaccgaagaggatatcgccctgcttgaccggcaggaaaaggagaaagatctggcagcggaagcggccgatgccaagaggcgggagcaggaagctctcgcagaactggaaaaagcactcgccgaagcgaggttgagaggacaacgggaggtcatgccgtccgcaacggacagcaccgcaacggtggctccgccggacacgatgacgcagaccaagggaaccatcgacgaggaaagccgttcggtcaaagctcctgcggagacggacaaggcaagcgaggtggtgaagaaggtaaagacgacttcggactacttcaacacactggcgaaagatgcacgggaaccgaaactcatcaaggcgatcatcgacgaaaacatcaaggccgtggacggctcgcgtgtgcggctgcgcctgctggacgacatcgaaatcaacgagagcgtggtcaggcgtggtacttacctgtatgccacagtcagcggtttctcttccggacgtgtaaaaggaagcatcaacagcatattggtggaggacgaactggtcaaggtcagcttgtcaatctacgatacggacgggctggaaggactttacgtacccatcagccaattccgcgagacaagcaaggacgtggcgagcagtgccatgtcgggcagcatgaacatgaataccagcggatacggtaacagcctcgcccaatggggtatgcaggcggtgaacaatgcctaccagaaaacgagtaacgccatcagcaaggccatcaagaaaaacaaggtgaagctgaaatacgggacgtttgtgtatctggtgaacggacgggaaaacaggaactaaaaggtcagtgacaatggaaacagatatatcaaaacttcataagggaacggacggcttctattacgaagactacatcgctcccgataagcccgaaacattcgttgggaagctcgtaagtaccgaatggtggcacaaaggggtacgattcgccctgatatgcaactttcaggcagtggacgggcggaggattgccttattcgccttccagaagcataccggtttttacgggccgagagacggtgcggtcaatttcaaacatgtggagaagaataccctctgggagtgtgaaatccggaaaacccggacggaacgctgtacctggatgagcgcccggcaaattgtagaaccgaaaacagacgcaatatgatagagacggatcgcatttaccttatggactgcatggagggcatgaaacagatagcggatggtagcgtggacgccataatcgccgacctaccttacggggtgttaaatcgcagcaatccgtcggtgaactgggaccgccagataccgttagcagccttgtgggagcaataccggcggattaccaagccggacagccccattatcctgttcgggcaggggcttttctccgcatggctcatgctgtcgcaaccccggctatggcggtacaacctcgtgtggcagaaagatcgggtgacgggacatctcaatgccaaacgtatgccgctccggcagcacgaggatattctggtattctataaaaaacagccggcctatcatccgcagatgacaccgtgtcctccggaacggagaaatcacgggaggcgtaaaacggagggatttaccaaccgttgttacggaacgatgaaactctcaccggtacgcatagccgatgacaaatatccgacctcggtcatcttcatgccgaaggaacacaagaaaggcgcgttctaccacccgacacaaaagcccgtggcgttgatggagtacctgatacggacctacaccgacgaaggcgatgttgtactggataactgtatcgggtcaggcacaaccgccgtggccgctatccgcacgggacggcactacatcggatttgaaatcgaacaggcgtactgcgagattgccgagcggcagattcaggaggaactggaatgcaggaacaaggtacaagaggaaaaagagataagggaagaaaaacaaaatcaataaatcaatgacatggacaaaaaaggaatcgtaacggcatttcttctggcggcagggctgctgggaacgccgaatgtacaggcacaacgaacctacgaggagatggaacaacttacggtaaatgaacaggtaacgacggtcatcacggcctcggaaccggtacgcttcgtggacatctccacagataagattgtcggcgaccaaccgatagacaatatcgtccgcctgaaaccgaaagagggcggacacgaggacggcgaggtgctggccatcgtgactatcgtaacggaacgctaccgcacgcagtatgcgctgctctacaccacacgggtgcgggaggcggtaactgacaaggaaatccagttgcaggaacggaacgcctatcacaacccggcggtctcgatgtccaccgtggatatgacacgcttcgcccggcgtatctggaactcgcccgcgaagatccgcaacgtcgccaccaaggcacatcgcatgaccatgcggctgaacaacatctactccgtgggtgagtatttcttcatcgacttctcgatagagaaccggacgaacatccgcttcgacatcgacgagatacgggtgaagctggcagacaagaaactgaccaaggcgaccaacgcacaggtcatcgaactgaccccggcactggtgctggaggcgggcaagacgttccggcacggctaccggaatgtggtcgtggtcaagaaaatgacgttcccgaacgacaaggtgctgaccatcgagatgacggagaaacaaatcagcgggcgtaacatcagcctgaatatcgactatgaggacgtgctgtcagccgattcgttcagcgcggcattgctggaggaggaatgacgatgaaaaagacgattatcctgacgattgcctgcatgtgcctcgccgtaggagcgtatgcacagcgaggcagcggccgcctctcactcggtgcggggctgctgtacaagaacgggctggacgtgacgctggcctacgaacacgagatgaactaccgccatgcgtgggagttctttgccaacggctacctgcaatgggcagagtgcgaatcctgcaaacatgtatgcccgaaatctttctggcggaactaccgcacctacagcttcggcgtggcttacaaaccctgcgtcacgaggggacgcaaccattacggaagcctccgaatcggggcttcgggcggaagcgacacgaagaagttccttgcaggactgcatttcggctacgagcacaactatgtgttgcgggcgggctggacgctatactggcaagtcaagggagacgtaatgataaagggggccgacgtgctgcgtacaggggttgccctcggcattaaactacctataaaataagggaaagatgaaacagaacattatcagaaaaacgtgccaggtagtgccggttctcctcataaccggggcgttggctgcctgcgacgcacatatagaagaatccgaagaaacaaaatatcccgtacacgtcctctgtgtggacgggacagtaataccgtacagtgagtacgaacaatccaaggaacaggcgattgccgtcgtcttccatatcggctccgacggggaaacggaaggaaacggctatgccgtctatctgtgggatatgacgccgaaagcttttgccgacagccttggtgtcgagcagggtacgtcagcagacatcacggcatacgacgggaatgagaacacgttcgccttgtatgaaacagaagagacagcctcgccgatggctgaagccgtttttgccctgtggaaatacgggcagagcgcctatgttccctcggtggctcagatgcgcctgctgtatgcggcacgtggcattatcaatccggtcatcgagaaatgcggcggagacccgcttccgaccgaagccgacgagtgctggtactggacatcgacggaggtggaaggacagcagacggtcaaagcatggctctactcgacagccagcggagccatgcaggaaacgcccaagacgcaggcgcataaagtgcgtcccattataaccatcaacaactgaatttatgattatgaacggaattaaagatttcaatgcaccacaatatgtggatatagtacatccggacaaaggatttttcgggtatctgttgagatgcaaatgtcctaagcaagaggacgtttccggtaattacatattcctcgatgatggaatagactgctacgagaggtttccttccgcaaagaaccgcagggaagaaatccggacggaatggaacggccgtatcagccgttaccatgatattttccaagggcagctctactatgtcaatgaagaattgattgaaggtttcattgatttcatgacttgtggctctaacgatgctgtccggattttccttgagaagtttacagcggaagtacgggcttctgcaatatatgacgctttaaggcttaaacctctatatgcagtttcccatgtctgccagcttactgctgataaccgtatgcaatggcctcatatccatgttctctggggcattaaaaagaattgacatagcaatggaagagagcaaggaattacagggattttaccggatattccgtgcggtggtatatgtctccgtactgatggagtttttcgagtatgccatcgacccggctatgctggaccactggggcggcatactctgcgacattcacggacgtatcaagcagtggaccatctataacgacggaaacctcgtgtacagtaaggtcgccacggtgctactcatctgcattacatgtataggcaccagagccaagaaacatttggagttcaacgcccggcggcaggtcttgtacccactcataagcggttttgttctgttagtgctgtccgtatggctgttcggttatccgatggaggcacgactttatacgctgccgctgaatattatcttctatatgacaacttccctcgtgggggttatcctcgtgcatgtcgcactggacaacatctccaagttcctcaaggagggactgatgaaggaccgcttcaacttcgagaacgagagtttcgagcagtgcgaggaactgatagagaccccgtacagcgtgaatatccctatgcgatattactacaagggcaaatttcgtaaaggctggaccaacataaccaactgtttccgtggaacgtgggtagtcggaacaccggggtcgggtaagacattcagtatcatcgagccgtttatccggcagcactcggccaagggattcgcaatggtggtctatgactataagttcccgactctggctacgaagctgtactaccactacaagaaaaaccagaaactcggcaagctgccccaaggctgccagttcaacatgattaatttcgtggacgtggagtacagccgccgggtaaatcccattcaggcgaaatacatcaacaacctcgctgcggccagcgagacggcggagacgctgttggagagcctgcaaaaaggcaagaaagagggaggcggtggcagcgaccagttcttccagacctcggctgtgaacttcctcgccgcctgcatctatttcttcgtgaactacgagcgcgagccttatgatgtcaaaggaaacaaactgtacgcagagaaacggcaagaccctgaaacgaaattctggaagccaacgggtgtggtgcgggacaaagagggcggagaaatcgttgaacctgcctactggctgggaaaatactcggacatgccgcatatcctgtcgttcctgaatgagagttaccaaaccattttcgaggtactggagaccgacaacgaggtagccccattgctcggtccgttccagacggctttcaaaaacaaggcaatggagcagctggaaggtatgataggtacgctgcgtgtctatacctcgcgcttggcgaccaaagagagttactggatattccatcgtgacggcgacgacttcgacctgaaggtgagcgacccgaagaatccgagttacctgctgatagcgaacgacccggagatggagagcattatcggggcactgaacgcccttattttgaaccgtctcgttacccgcgtaaataccgggcagggcaagaacatccccgtgagcattatcgtggacgagctgccgacactttatttccacaagatagaccgcctgatcggtacggcacgaagcaacaaggtgagcgtgacgctcggtttccaagagctgccgcagctcgaagcggattacggaaaggtgggtatgcaaaaaatcatcacgacggtgggcaatgtggtgagcggttcagcccgtgccaaggagacgctggaatggctgtcaagcgacatattcggcaaggtggtgcaaatcaaaaagggtgtcacgatagaccgggacaaaacttccatcaacctgaatgaaaacatggacagcctcgtacccgcctcgaaaatctcggatatgccgacgggctggatatgcggtcagacggcacgggacttcatccaaacaaaaaccggtataggaggttcgatgaacgtacaggaatcggaggagttcaagacctcgaagttcttctgcaaaacggatttcgacatgaaggaaatcaagaaggaggaagctgcgtatgtaccactgccgaagttctacacgttcaagtcgagggaggaacgggaacgcattctttaccggaatttcgtgaatgtgggaatagaggtgaaagaaatgataaaggacgtgctgaacaaaaggggtgcgaaatagaaagtcggcttccgttatggaaagaagcaaaacgcctgcaatgattccgtgattattgcaggcgtttcggtgtttcctatctatttttcacacttccgaggactgttcccgacattcgtccatcaagaactgttctaattgctgacggtttggcaactgtaactggtatgtcgaaacaaaaagatgattatccatactgccaagggcgtattccaccatcttctttcctttgtgtgtacaaagcaaaataccgaccggaggattgtcgcccggctgcatttcattctcggcataatagctgacataggcattcagctgtcctatgtgttcatggcggaactcgtcattttttaattccacaatgacattgcaatgaagcaaccggttgtagaaaacgagatccgcaaaataatattctccgtctatgatgatgcgtttctgacgcgcctcgaaacagaagcctttcccaagttccagcaagaactcctgcaagtgtccgagcagggcttcttcaatatcgctttccgtaacgacatctttggcttggagaccgagaaactcaaacgtataggggtcgcgtatctgcaaaagcggggtgtgtcgctctgccttgctgtctgcaagcatcatcgctttcatcttatcctccgacagtccgatgcgaatgtgaaggttggaaacaatctgacggcgtaattcacgcacactccatgttccccgaatacattccgtttcatagaaaaaacgtaccaacgggtcttctatcgtaagcaactccctgatatgcgaaaaggaaagtgcagaaaccaaattctcagggggtgtattgaactgttcagaaagcttgcctgcatttttcttattaacagcgaaagagtcaatttccggcaatttgtgcgacactgtcgcataaatttctgataacggcaatttatgcaacgccgtcgcatgatttgcggaaaccagtgtaccgatatgcggataatctctataaaacaatcgtgaaagttggaaaagggtgacattcaggcccttttgcccgatacgtttttccagacttttcagcagattgtccccgtacttggcccggtcgctgccattttgttcgtattcaacaatataacatccgattatccaattgcgtaacgtggttgcctgattgatggttttaaccgccaccccacgcattgaatcatcgacggttataatcttttgagccaactgctcaaaggatatgctttgtattgaatttgctaattgttccatatctgactgtaaatcggaaacaaatataggaaaaatacaggagacaccggtcgtttgttgctgttgaattgataataacggcattaaaatgtatagagggagggtgcacgaacccgacgcttgcactctgaccgatggtgattacctgaaacgagtcaaatcaagtcatgggataatatttgccgcctatcatagacagcagctgcttgcgttgtttaccctccgagttcttatacccgatgtgcatccacgacggtactccctgactgttttctttctcggaaatcaactggtcaaactctcttactctaagaaaaccacgacagaaactcttgaattccatcatattgccgtttacgggaatcaggtcgaaggcatagccggagtaatgcccccgttattactttgtgaacctgcatcgcaaatataaagggagcaggcagtcacagacaatccgttttatgaacgactgaaatcatttacaaacggcagatttttattcttttctgcattatatacagaaaagccgtaccctgttcgtttaccgacaaggcacggctctcgtcccccaaaaagaggaatcagacagtgacaacagttacatataaattctgtcgctcctgttcacagaatttatcatacttggctttgtccgtaccgctttcgatagccctgtcgatgacaccgcccagttcatcgaaacaaacctcgttgttcacacattccacgtccattcccttcacaagataaacctcgtaatagtccgaaccattgagcacgacgatgacatatcccgcgtgcagtcgtccgtttaccttgattcggagtgccggcaaatccctgtatagagtggcggcaaattcttcgatactccatgacatgaggacggtcatgggggttaacgctactaactgttccttaatgatctgtgcaacctgcattacatattctttttccataactctaagtttgtaagtttataaattattattccatgattcactcgaaccagtccgggttatcctttttgagttcggctaccagctcgttttcgggcagttgaagggttctctcatcggtaaagaagaaaacttcgtcataaatgctttcggcttctttactggcgaaaccttcgttttcgtcattgaaactaccgggctgcagagcatccagcagggtggtcggggcaatcagcagttcttcgccatcgttggcttccacaatacggcatacatagctcttgccgccaaattgaatttcatttgttttcatattatcctccttattttaatggtatattacgtccgtgttcattgaggtactccatgatgcgcttcgcttcctcgtgcgaggcttggtttcgttcgtcatagtgccgcgtttcgtccgccatgaccttgatacacgccttaatcaggcgatacaggctttgctgaagcgtggggtgcatgtcggggattgccgctgcgaaccgttcggggttgaaactgaaactgtttaccgccatttcccagtctttggcgaggcgatattctttgctttctttaatgtccatattcttgaattttaatagttctcgttgcatattttgtcaagttccctaattatgggtgtcacctctttgcctgtaagcctttctatgtcatacagcaaatgctccaagcggtcatacgccttttctcccgcttttgtaaattctccggtgctgtcgaatgcgttaccttcacaccccagttcttgcaataattcttctaatgtcttcatttgttgaatttttaatgattgtttttctttccctctgctcggcttccttgttaccggagccgcttcgggttttatggtgctttccggggctggcgaaaaagccctttccgacgttttttcttgccaattacgcttcgtagaaggaagaatttgcaagaaatgcaattcaaaacgacggaatcaggcgcgacagcccatatttgcaccgataaaaaccgatgcggtgacggacaggaaagccagacggaagagaatacggagacctgaaagtggtagaaaaggacggctggaaactaaaaaagaaaattatatatctatatatggataattgttgctatatttgcatataaatagtgatatattgatattatgggagcaacgaactataccacaaacagcgatatgctgacgcttctggcgttgcgtgtcaaggagtaccgtctggcagctcgcatgagccagaaggagctggccgaacagtcgggcgtgagccagacgacaatcagccattttgaacaaggggtcagccgtaacctaaccttggccaatttcatctccctgctgcgtgcgctcggtcaggaacagcggctcgcggaaatcctgccggaactgcccatgccgccgatggcacttcgggaaattgagaaactgatacctaaacgagttaggaggggcaagaaatgatagaaagtctcgatgtaatcctatgggataaaaaggtcggcacgcttgtcgccaaccgggaaggacaccgcagcaaagcctgtttctacttcgacagcgattatgtccgcaacggctatgatatcgccccgctccgtgcgccggtaaaaggggttgccgcacagcgcggcctgccggtctatcccgatgaagagcggcttttcggcggcctgccgtcgttcatagccgattcactgcccgaccattggggaaacaccgtgttcaacgaatgggccaaagtgcatcatatccgtatgagggacttgtccgccctcgaccgtctcgcctatatcggacggcgtggcatgggggcattggagttcgtcccgcccactgccgaggaactggagacaccgttcaaggtcgagatcgccgatctctaccaactggcccggcaggctttcgaggaagccggacggttcaacgtcccggtatcgggcaacctgatggtcgaaagcctgttcaaggtgggtacgtccgcaggagggcgacggcccaaggcagtggtcaacgtcaatttcgaggagggacaatgttactccggacaggtggcgaccccttatccgggctacacgccgatgatcgtcaagttcgacgaacaccagaagatgccgacgacacggatagaatacagctattacctgatggctgtggatgccgagcttcagatgatgccgagccgcctgcttgaaggcgagcagacagcgcacttcctgaccgagcgtttcgaccgccagaacggcaagaaggtgcatatccagacattggctgccatgaacccctcggcggattcttacgaagcactgttcgaggcagcttgccgtatcggcgtgccgccgggggaactccggcaactgttccgctcgatggtgctgaacgttctgggcgggaacgtcgatgaccataacaagaatttcagcttcctgatggacgacgacgggcattggcacgttgctccggcctatgactacacgttctcggtcgatccggacgcaccgtattacgtcaaccgccacagcatgacagtcaacaacaagacggagggcattactgcggaggatttgctggaagtagcccgccggtatggtataaaggccgcagagccgttcatagaaaaggccataggtatcgtctcgcattacccggaatacggccgggaggccggtgtcggagaggaatggataggaacgatagaaaaggaaatcgccgcacgaatagagtgcgtgagcgacaaccgggcagaccgattaaaatagagcgtgggatttcatgtaggggaaatgagggggtgtgtcaaaactaaaatgtcccctccgaaaagttatagattgtaactatgacattttaaaacggtcgtattaagctctgtattgagtaatgatacgacccttttttagcctttgagggtactcaaatttcaaattctaagttcatagcttcaaaaattgagttttgacacactctcttgtcattgtcattccgcccctttcttgcttaggagggtcaactggtcgggacggtcgggaaaccaataggcgtcgctgtcaagatacacacatctgtcaccgttccaaggcttcctgaaagctaatacctcttgggggccgaatactactccataatcgtttgtaaatgccactatgtcgcctacagccaaatcgtcctccgtatccatgacttcggaaaggcgattgtaaaactccatgccttcggcttcacgttccgctttccagcgcaaaaaatcctctttgtgacttctgcccgtacttatcggtgataattccgaaggcaaaacctccgcttccgaagtaccggacgaaatcagaataatgctgtcgtcttccatgttttccggtgcagaaatcactcggtaagccccgtcggacaaaccgttgtccgggtcatgccaataaagcagattcccggtcttgataaaatcgtattttcccattgtcttgtgagttattgattatttattttccttttttcgattcctttccttcggaatcgcttcgaggttttacagatgcaatgcacggtcgtcggcacggcttcatacgacggctcttcttgccaattacgcttcacttgggaaggaagaatttgcaagaagtgcacttcaagccggcgaatcaagcgcgacgtccgactttcgcatcggataaaacccgtgcggtgagggccggaaaagtcggatgggaagaacaggcggttcataccgctacaaaagggaaagaatgcaattataagaggaaatgggcggtggcggggtatccgggaggctgactataaaaggacgaaggcgggcgataaagacaaaggagacagcgcactgactgtattatcggtacgctatcttgtacattcaattttcggaacccgatgcttttctattcgtggaacaatcctttttcaaaaacattcttctccgaatagctcgatgttcgctttttggaaaatttgcgggttatgctgataaagaagcggcaggttcaacatagccatagggtattccacgaagccgctcctgcgcttatactcggaatcggtcgccagtccgtttttcaccaagaactccattgcttcggggtaatgattgacgtcgataaatgtacggtccggcagaccgagtgcgtccatttcctccaaattaacggaaagcacgatatattcgtcttcatcttccaccattaccaaggtgagagccaaccaaccattgcggtaaaactctggtacgaggtaatactgttcgcctctgaactcgtattctttctgcctgaaagagctgtccggctctacgatttcaaattcatcttcacctgcggcaaaagcaatcatagggttactggcatctacatacgcttcacctgctttgtagcacaaatactctctgttttcggaacgcacgatagcaaattgaatttccataaaattttaacattaatcagttgaacaatctgtttattttttccctcctttcggaagccttcaggcttctcccgtcgggatttgatttttacgtgcatcaaagattgcctttcagggagaaacaggcaaggaatttgggcagaattttatagttgcggtattgagcgtccgcgaaatatggacgattgaaaatcgggaaagctgctgaaaaattgtgttcaaatagcgtagcggtacttgaatgttcctccaaggcaatacctttgcaccggaaaaagcatgtcccgacgggcagagccgtcggcgaagggatttccatacaaaaggaaaacgaaggggtaaaaagggagatctgccggcggcagtgctaaaaaagacagccactcctgcggctatctccctgtagcgttgcgctatttttttccggccttgctatccggcttgtctttccgtttcttcggagaaaacaatccgttgaaacaaaccgtcgtggcaaaggtacgtgcctgtgtcgcattgcacaatcctgctccgggcattgttgcaccgttgtaatgtttgcagtccttacatttcatcattacctctttttagaaaccagcagggcggatttctccgtcctgctattgaattatggtcaagcagcaacctcttcggtttgcgtatgttcttcgggttgtacctctgccgtgggttgtgtattttccgcctcggcggtttcttcgggctttgtctgccgttcctttgccaacaaggcggctttgcgttcctcgatacgtttatggcgtttctcatacacctcattatatccactttcaatttcggcgagcgtgtcgggcatgtgcttacgggcaaaatcgagcaagagggtggcagtagcgttattgccgtatgcgcctttgaagttgtctatcaagaaatccctgcggataacggctttctgcttggccgttaggttggcgatgatgttcatcttttcttcgtcctcaaggtgttggtaggcttttttctccccgataccgaataccccgaagtgttccctgcggagagacgacagcaggaagaaatatatcatcttttcctcgtcctgcgtgaatttgctttcggacatatcgacgtccaaaatctgtttcttagcgtctgcaacggttttctcgacggctatttccttgttacgtttgtcctgcttctccagtttttccaccggggagagttgtttttcggtagccatgtccgcattggcggcagcacttgccatataacacagcgtaatttctttctgtccgatactaatataaaacgtgagttcgcccgtgtcaattcgttcatggattgacttgcatttttccatatagttgctgaaatcctgctcgtactccttgtatgcctcctcgtattcctcgatagtgtcgtattcttccttttcgggagctaccggcgtttcggggtatggcgtggcataggtatttaggtgctcgacctcgtaccccatagcggtaaggcgttccaccgcaatcatgttgttgttgaaatcttggtagcatagcgatacggaggggtattgttccacgaactgcacggctttctccacgagataggaagcgttcatttcggccagacaactccggttggcgcaatttccgcaaccaccctcgcagaacaacatcatgttgttggtattgtgggggcatgaggcgcacaaggtcttgtcgaatgcgtaacggctaaggtctgtcgtgaaatcccgttcgataaactttgccacctcggcggctttcagtcctcgccaacagtcgtacaacatgctgtcgctgtctttcaaatgtttgtagtacacctctttttgaatatccgtaccgtatcggcaaatctcactcgccacgctgattgtaatttcgtccttttccaaaagttcggctatttcgggtatcagtgagacgaatttcagacgggtacggatatagttctcgttcttgccgaactgctcggccaatgactgcacatcatagcgaccgctctccataagtttttggtaggcgttggcttcctctatgggggtaacgtccttgcgctgcagattctccgtcacggccatttcggcggcggtctcgtccgaaacatgcaagatgacggctgaaatctcggtcagttctgccataagggcggcacgatacctgcgctctccgaaaacaatctcgaagcggtcggtgtccgcaatggggcgcacgccgataggttgcaacactccctgctgacgaatactctcggccagttcggcaaggctcacctcgtcaaagtgcttgcgtgggttataactgctcggctgaatattcatcaatgcaaccgatacgatgttgttctctactactgattgaatgtttgctgtttccataattcataaattttaatttgttattacattagattgtttgattactattgtctttattgtgcggtgtcaaactcgtactcctgcggattgtcgtacccgtcgaacactacccgaaaagtgtcaaagtcctttctgcccgccagtctgacggtatctcttttcccgatgaaatagggttcattcattgtccgaaacggtgcgccgagcgttatcctatccaccaacgtacaaactttgtcgggttgttcgggcatgatataacccagtgcgtactcgttataaactaccaatttgattttatccatatcgctgtcaattttacgttgttttttctttccctcctttcggttcctttctctgcctgaaccgctttgaggttttacggatgcggtgcacggctgtcggtacagcttcatacgacggcttttcctgccaattactctttcgtagaaaggaagaatttgcaggaaatgcacttcaagccgccgtatcaagcgcgacagcggacctttgcatctgataaaacacaacggtgacggcagagaatgaagccgggacagcggtaaaggaatcggtaaaaaagggatatgcccgtcagggttagaatagggataaaacgggcaatgtgcctgtacttgcgggcaggtaaaaagaaaaagatggtaagactataaaggtggaatgcgccctatggaaaacagcgggcggataaaaaaggacgcatggctaccgtctccggggtgggcagatgcggcagccatgcctgtttactgttcgttcttttccagatattctttcattgcctcgttcacgatgtctttcagcgacatgttcttcttgatggcgaggaatttcatacgggtatgaatgcttttgttgatgacgaagttgcaatgaaccgccgtttctttctccgtgggggctgctaccggctgttttccgccggtagattttttcgtggacgacagcaacccgtccagtccgcccttcatactgtctttcagtaaatcgctcttgctcatatcggggttattttaatttcagtacctcttgcgccagagccatgtagtccttagccccgttgctgttcttgctgtactcgaagatgttcttgccctttatgggcgcttcggccaaagatacattgtcccgtataacggtcttgaacaccttgtcgcagaatgaatccttgacgagttcggccacgctcttgttcagcgtcttgcgtttgtcaaactgcgtaatgacgataccgccaatggcgagtttcgggttcaagcgttcctggacggtggcaatcacgttcatgattttggccatgccgcgcatggcgaggaactgtgcctgtaccgggataatcaggtagtctgccgcagtaagggcgttcagtgtaagcaatcccagcgagggtggacagtcgataaggatataatcgaatttccggtgatcgagcgatttggctattagcccgctcaatatcagttcccgtcccggctcgttgatgagttcggcctcggcagccgagagatcgagacaggacggtacgacggtaacacctcctgccgtttcaactaacggcaaggggtatttgcctttcatcgccccgtacacggtctgttcctcctcaatggagaggccgaaggattccgtgagatttgcctgaccatccatgtcgatagccagcacgcgctttttcttctgctgcaaggccgcagccagattgatggtggtggtcgtctttccgaccccgcctttatggtttagaaccgcaattatttttgtcataacatattgcctttaaattcaatacaaagataatactatttttagtaattactaattttagtatatactaatttactacaatatataattttagtatatactaatttactacaatatataattttagtatattagtattatagtatttactattatactaaatatagtatatactatacagtaaggcagatttgctctgtactacagtactttttaaatgcaagaattaagtgtattcttcagaaaaaatccttcgagtacactttacagatgagtacaaaaaaacaagagaatccatagcaattattgtagcaatagattctcttgtctaataaggcttggtttatttatcagcaaatttcaaatgagaaagggtcagaaagtaaatcaatagagattttacaaatttaccaatactcgatggttcgtttctctgtatattcttctggagcagtatattcatcgccgacatagttcccattgtcatcatacttatcgtattcggtggtgtagcttaccttccgctctatccaattcttgtgcttgtcgaacttggtataggtatagcgataagtggtgttaccttcttccgggtgctcctgtatcatcgtggccgggtatttgctgtcaccttcatagctgtatttccaagtgacgtatgccatgtgcgaagtaaactgatgactgatgatacgattgcgcttatcaaacatataggtctggtcaagttccgtgttggtatcagcatccggacaaatatccgtccgcataccatcttttgattcgatgttcaccacataatctccccatccttccactttgtaggaagtagctgtgacatattgataggccgcttcgtctccgaacttgttctgcatggcaatcagattgcccgcctggtcaaatttgagtgattcctcattgccgtttaccgacttgactttaccggacaacccataaatatccgttcctttgtagcgtaaactacccattaggacaggttgaccgttttcttttgcagctttcatggaagcaatcgtttcatcgtcccagtaatcaatgctgcggacaactgtcaggctgggagtctcacccgctttgacagcagaagaacgatcccgattcgatgtaaatccgtctctgaaagccttatagtaggtacgcaatgcaggtatctcatcgatgttagccgggaatgtaacggtagcttgtgtccagtttcctttttcatcatatacataatcgtaggagacggtaaacgtcatgtcatccacccgccagttgttgcctttacttttatatacacctccgctatacgtccaagtagccaagtctccgtgtgagttatacgcaaagctgctggtacaagtcagtgtttcgttccccccgtcaaattcaacgggaatcttctctacggcttgtgtacacagatggcctgtatagacataggttgtcaccgattgtcctgtcttgtaactgtcgatgtctttcaagaacatgttcgtggtcttcggtgtttcaaaagacttcaagtgagcgagcgagtcaaactgcatctcatgaagcgtcacgcccgattcattgaccgtgccattctttttttcgggcaggatggattgcaataccccattaccgtgataggcatacagaaaagtggttgtgtcataatgtccccgcccgttcttgtcgcgacgtatcaaccgacctgcactgtcgtatgtgaagccgtcatcttttttccggcgtttgtaacgtccgtcatctaccgatttgatttgggtcagattggaattgccgttatattcatacgaaatgacatcaaatccggttgcacccacattgaaagaagtgcgccgctgttcggataaacggccgttaggcaagaactcgtattgcgaggtgcttgtcaccccccattgtgcattgtggtattcgtaggtgaccagcttcggatagttgcgcaatcccatctttgcccaatccgtaggatagtttacgaaataaggcatcagatgttccgcattcatatccactcttaccggatcaaaatacacctgaagcggtgtataaggctggttgctttcttcactgccacagcttgctgctcctatcgacagcaagcaagaaagagcgacagcttgtatggtctgtaatgctttcatgttccgttatttttgatttgttggatgattttccttgcaggggacctgcttggtgacaggatgataagagatattccagacgggataagctccgaccttatctacacagcacgaatgcagataacagttcccgtgtatcgagctttccgaacccagcaatccggagatgtatttgcatccttttcccgacacaatgattttgccttcattcaccacctgatggaaagaggaacctccgaaactgccgattactcctccgatggcggaaaattcagccagcaggtcatgcttgatttcgatgttgcctgcattgtacagatccaacggatagattcgttcgtagttgtgaggtgtcagttcgccacatacccctccgatattaaatgtagcagatgtattctgtgtgtccaagcggatgtttccccaattatggagatgctctatatcagtttcattggttttgaaaagtccgacaacaccaccgatgtagctatgatcaggttgggcatcggccttccactgcacggtcaaatcgcctttattctcgacgcagacattctctttgataaagattttaccataattggtggccctcccgatgactccacctatgtaggcatcactgcacggattaacggtgaggttgccctcattgattatcttgccacgcaaagccacttccacttcggagccgtagctatccaggtctccgacaagtccacccagacagagtgtacagatacccttattgtcagcgaatgagatatccaccttgctggtacaattctcgatacatccattcttgaactctcccgccagagaaccggcaagcaggctataaccgtcttctctcttttgagcgtcgatggtcatgtcacctgccaatgtcagatccttgaccacagcttctttttcaccacccatttcttcaaacagaccgacatcaaatactcctttggagctctcttcaatgaccacccgtattccgtcgaaggtaatggtatgtccgttgccgtcgaactccctaaccgggaatttaatcggtgtccattcaccgctgatttcgatgtccttcaccagtttaatccgcacttcatctgctggaatctccttgcctgcatcggtgagcagcgtttgtgcttccatgtttttatccttgatttcgaacgtttcgttcaggaaacgcagttcactctcttttccgatttcaaatacctgttccgcctcgttgaaatgcaaggcggtgactttctcttcacacgatgtcagccaaaaaggcaggcaagcgacaaggtaaaccattcttttcatgctgctgctctttttacatatctgctgcataattctcgccctccatgataaacattcccgactctttccagtaatacaccacataaggctctactttcgacatttcattgatgtcctgcgtgggcattccactaaaataggtaaagaccagtgcgttaccctctatttttccggcatacgactccacgcttgacataggaatgctttcaccttgtggaggatacatggtcgttttgaccataaaaacttgttctcctttcttttccagtgtgaacgatgtcagagcattggcataactttttgaaaaagcatgttctgggatggtgttatctttcaagtaaaaagcatacttcggagaaatatatccgatacgtttgtcttgggcagaaagctctaccttgaaccatcccttttctttccccaagaatctgaagctttgtccacggttggctttcattaaagaactacccgatacaggggtggaacggacattgattttatctcctccactgatgaatacgtagttacatttatctttctgcttaaacactaccggctctgaaccgggtggcaagaaggacagttccttcgtggtgggattgtacttgaactccgctttttgttttcccatactgctttctacggcaaccgaagcctctgtattatcaatgtgatagacgtctacaatactataggtaagcccatagcctccttcaaacacattgtaagcaccgtaactgccatctgtcggtgtgttgtaaaggtctatttccaactgaatttggctgttgccttcccaatattcccatttgcccacaaagggttttgtgtcatctgcttgtatagacgcgtgtacactcaagaagccacaaacaaggcttatcaaacttaggcatatcaattttttcattatgctgttgctttatatggttaaaattaaagactaaaagtgacatatacggcagactgtacccgtacaggctgtccgtctttgattccgggtgtccattcctttaaggacttgaccactcttacggcttcggtattgagattggcatgaacctttttcacagccgtaacatcagataccgaaccgtctttctccactataaaggaaacaagcacatcgccctgaatcttctgctgtttgcagatcatgggataacgtatgcttcgggcaatatccgccagcaatgcttggtttccaccggggtattccggctccttatccacctcgctgcctttgtacaccttattggggcttaccttggattgtgccggttctcgtctatcttccttcggagtggttggcataccaaatcttctttcgggagtatctttgtctgtttctttttgctcttccaattcctgttgtaatgttctttgcaacacttcactggagataagaaaaccgttgaacttagaaggagcgtacccggagaatgccgataccacttcgaaactgaatgtttttccctcctcgatacgtggaaaataataagtacccgctgtttttatccgattgcccggcatcaggtagaacaagtctatgggcaaactgcggcttgtcttctgtgccactccctttatctgaaatttatagccgccattagcgcgtcccgtacaagtaacgctggtaacatgccaataacgatccactccggcatcgcatttgaacggcacatttaccggataactcttgggaggaatggaaaaacttgtttgcgcaaaagtcgcatgactcatgaagaatgcccctaagacaatgaggcatagtaaaatagataatcgcttcatacgtatatcgttttatagtttttagattcatcagagtttaaacgtgataggcagagtgtattccacatttaccggtttgccatcctgtgtaccgggaatccaacgaggcatggacttcactacgcggacagcttccttatccaaataaggatctacagacttggtaacacgaatatttgagatagagccatcgctcttgactgtaaatttcaccaacactttgccttgtattttctgttccttgcaaactgtcggaaactttagattctttgataaaaattgtaccaatgcggtgataccaccgggaaattccggagacacctctctcttgttctgggaaacttttgccatcgaaggcaaatcattgatagttcttgcctcatttgcagcctgtgtatccaaacagttgccaatcagcagtgcggatagtaaactgctcaaaataatttgttttttcatacagttttattgtttaattatcaatacgttacattattcatttatttgcgataaaatccggaactgtcgcgtccccatttgccgccaaattggtcggtgtaatcacactcgctatagggagaatcttgtgtaagatgatataatgttccagaatcagtaaaacttgctgttttcaaaccacttgaactgcttgatgatgaaccgctccaagactccgtcgctcccttatgcaagtctttaaaaccgagaatacccataataagacctatcccgttgcctatactgaatccccattgggccatatcccacatggtaccagagtctatccaacccagccaatcaagaataaaacctactgccaatccaatcgctccaacaatcaaacctacaaccagcatcaatgcgaagaattgtaacacaatcttaataatgtagatggctatgcctaaaaacagtatccactttatcgctgtgaaccaagccgattctccttcggaatcaaacaaccaagaggttaagtcccatgactcttctttggtggaagtacccgcttcgtctgtttctgttacggcttccagatacgatgcgctgacataaccctgccagccattataattgatattagcccatccgttttctatagatacaacatcaatcacgttatccttagacaattgtcctaatagttttccgtttttattggctgaagctcgtacattaagaccgttgggagcggtcactcgataatgatctgcaaaagattgcgtacatagggaaaaattaaggattagaaacaaaacccatttaataatgtttctgctaacgaacatattcttcagcatacaaatactttgctggctatatctgttcatcataaattaagactcttgcagtcccgtagagtctgcttgattaaaccacgaagcgtggaactgcaaatgccacgttctaagtcggaggtcgtaggaataacctttattcagagtatggtaatagcagcccacgctatagcgtgagaaaccaattacgcttttccctctgaatagtcttgaatttcctacgttcccgacttcgagataagcataacgcttctttcttttctaatatgtcttggaaagagtttcctcaatccggcacaaaggtagtgaaatttcatgaaacaggaccttatataccgtgattttcttaaagttatgagtggattttaagtctattgttctaaaaccaatattaaataaactgcaagaaagacaaatctattaaataatgggctaacattttctgaaaaactctgtaaggatagaaaaaatgtttgagatgtatgaactcttaagaaaggacgaaactaaaaaacaaaaatatagtatctactaattttaacaagaataggtttactaatttcctattttactatgattagtaaatactatatttagtatctgcttattttcagatagttattatcttatcagaagggcaaatcctccttttcgtcctgcggaaaatcggcgggaggaacgggtacgctgtctgcaccgtttacatcgttgtccgctccggctgccgcatcctcgcgttttccggtattgataaaggcaatgctttctgccgtgatggagagctgtatctggctctcgccgttcttgtctttccacagggaagatgacagtgtaccgtcaacgagtatgagtcttcctttcgtcagatattcggacaaatggatatggttgtccttgttgctgcgtacccttatccaagtggtagtgttttgtcctcttgaataatcgtcaacggctatgtccatagccatgaatgagccgtgtactcctgaaataacctggcagtctttgccgatgcgtccgatagtgtgaacatgtaacataatagaaaattgtttgtggcaaggtggttggtcctgcgttacctaaactgtttattttttcccttctttcggttcctttctctgcctgaaccgttccgggattttatagatgcggtacatggctgccggtagagcttcatgcgacggcttttcttgccaattactcttcgtagaaggaagaatttgcaagaaatgcacttcaagccgccggatcaagcgcggcagccgacctttgcatctgaaaaaccggacggcgacggcagagaggagaccgtagagattatacctataactgatataaaaggaagagggcttcgccaaagtataagagcagagggaaagagagaggtataaaaggaagccgacaacggagttgcggtatttataaacggatatcgtgccctccgccaatggtgttgccataggcacgattcccgtttatagccagttttgaccgggccggtatcttaaagagaggaaggcagcaaatcccccatcctctgttccggcatagtgcaaaatccacgaacgatagtatcttcgtttacaccttcaagtctggcgaacatttgcaacgcgtcaaatccacagtcgaactgttccatgctgacagcgggggcaaaatgaacaataccgtggggatagcttttcgagacacctatccacccacgcaaataatcatcgaagcgtccttccgcttgtgacgcatggaactcttgagcatgggagctgcaaatgcttttgccgtacatttcatctcctaaaattaaagttcccgtttgcggattgtacataaaacgccgattggttatctgaagaatatctatgatttcccgtttgacgtcgataaccatcaggattttttcaacctgccgttttgtgcgtttgcctgttttacagtttttcttgtccatctcttgtcttttatgtgaaacatctgttttttacccttttttcggttcttttctctgcctgaaccgttccgggattttacagatgcggtacacgactgccggcagggcttcatacggcggttttcccggccaattactctttcgcagaaaggaagaatttgcagggaatgcacttcaagccgccggatcaagcgcggcagccgacctttgcagctggaaaaccggacggcgatggcggagaggaaaccggaacaggccggtaaatatgatggtaaaaaggggggtacggccttgccggatataaatgcaggagaaaatgaaatagaaaagaatgcggcttgggcgggtcaagcaagggtctgccggggcaaacacgaacgggattctccttatccgctccacgcctgaatttcgaccgggcggaatgaaagcgcggggcggataagaagtatcgctgtttgcccttgacgtggcaggtcacaagggaaagatacggaacaggaggcggaaagtccgaaaccagcggcataaagaccggtcgggctgtggaataccgtgttgtttcgacaggtcgaagctccggcatggaacggcacgatccgggctgccgccggtttggaacggcctcccgtccctttccttgacgacttgttacggcacagacttccaactgtttacggggttgggaaagccgacgtataacagggaaaacagcctgaaggtaaaaaaggagataatcgtgctataaaaggtatcggttgccctgcaatctgtccgaaaggcattcgcccttcggacagaccacagaggttacaggcttatagtttgggcttgttcttcgggagaatgggacaagagagtattattctgtaaaatgaccccagctcggtctttaccgggtctttcgataccaagaatgtcgcgctctccttgactttcgctatatccaaaatggtcttacagatgtacttattcctcaagcgtgttcctcccctgttgaactgcagcgggaaaccttgtttgtcggcggtcttgtgcagaaaccattctttgggattgttctcgtcatgggcaaactccagacggtcattcatcgtgatattcatttcttttgccagtttggtggatagacccgcatttcatgttcaataacttcagcattctgtccgaactgatagtggaaaaccgtacattggcggaacgcttccttgagaatctgtcgagcgtttaccgttacgtcatccaaaacttgaagcgcgacaccgtgccggtaagcgaagagttggatttcctgcgttcctacctctacttgatagggatgcgctacgagaatgccataagcgtcgatgtggatgaacaactggagcggacagacggccggattccccccgtctgcctccagctgctggtagaaaacgccatcaaacacaaccgcttgtcggtacaccaaccgctgcatattcacgtctttcgggaaggaaaccacattgtggtgaaaaacgacctttgccccgtgtcgtccgacctgtcatctaccggtatcggacaacggaacatcatcgagcgttacttcctgttgtgcgaggaaaagcctgtcatcaagaaaagcgaacattcatatatagtcaaattacctattatacccgacgattatgcacatcctgatcatagaagatgaaaaacggaacttcaaccggctgaaaaggctgttggaagaaatcgacggcacattccgcatcgacgggccgttggcaagcattgtggaggcggtggaatggctacaggcacatcctgccccggagcttatattcgctgacatccgcctgtccgacggcctgagtttcgacgtgctgcgccggacggcagtgccctcgcctgtcatcttcaccaccgcttacgacgagtatgccatccaggccttcaaatacaacagtttcgattatctgctgaaacccgtcaaggccgacgagcttgccgccgccatggaaaaagtgcgccgcgcaagttccccgcagacaaacggcgaagaggtgcgccagctattggaatatatgcggcaaagcaattaccgttatcgcgagcgttttcttctgccttaccgcgacggctatatttccgtgcaggtgaaagatatcagccacatcgctttggacgaacgcaatacgctcctttgcctgaacaacggcacgtccgagaccgtgccttattctctcgacgagctggaatcccagctcaaccccgatgtctttttccgcgccaaccgccagtacctcatccatatagacagtatcttgagtatcaataactggttcaactcccgactgaagattcgtttgaagaagtatcccgatgtggaaatcatcgtaagccgggaaagggcggcggagctgaaaggatggttagacagataagcttatgaatacacctatattggaaacctcccgcctgatactgcggaagttcacggaaagagacatggaagccctcttcctgatactcaaagacgaagaagccaataaattcctgccttggtatccggtgaaagacctcgaagaaacccggcggttttatcaggaaaggtatgcggcgaaatacggacagccgcaagcctacgcctatgccatctgcctgaaaacggacaatttcccgataggctacgtgaaagtcgatatggaggaacaccacgatttcggctacgggctccgcaaggagttctggcatcgggggattgccactgaagcgggcggagccgtcatcgcccaagtgaggaaagacggtctgccctacatcaccgccacgcacgacaggaacaacccgagaagcggaaacgtgatgcggaagctcggcatgacgtaccgttactcatacgaagaactgtggcaacccaagaacttccccgtgatattcagaatgtaccagttaaacctgaatggcgacaacgagttcgtgtacaggaaatattgggacgaggcaaccaatcatttcgtagaagacttgtagccggacacgaagcctgttgttccggcgggacaagccattgctttttgtatgtttattctgtataacaagggggctggcatccaatccacaccaaccccactcttttttatctatcgccgcataggcataaagcgaaatattgctcctgtttccgctcagattaaatgatgtccagcttcataccgacgggtcatactgggttgctcgcctcacgggaaacaccgtcaggcttgcccgtagcagtcccaacaacaaaacaagatgaacagtccgaccgtgcagagagaaacggagataatgacgtgaaatatcagtagtttgttcaatattgagatatgccgccgagaacagcgtttcggaagcgaaaatattttgattcataccgtgcgaaaattttatttttttgattattcaatatattcaccacgaacagctacacctcgcttttcagccaagtgtagacatcagtataaaccatgaaaaacaaactgctaaatcagaatccgtctcatcccgaaaatataatgctcgcaggcattgtcccagttcgggctacgggaagagtcatgcacgagggtacaacaataggtcaggttgttcatgcggcaaatgagataccgctgtaaagttcggagaagatgggccgtttccacggatatgtaccgaagatgcaccccatttacctatgcgccggcacggcaagccacatcggggatttctccgactatgcctgttatgtcgctgtcctttttttgccggatagagtttctgtcatgaaattgcagaaaagaggcgttgtccgtatttcggacacaacattcctgcgcagccgccacaccggccgccggaacatgctgcgcaccggaactgcataccaaagccgtcagtaccaacgatagaacaacaacggacccttttatgctttaattttactttccatagggtaagcatagcccccctttcttaccatttccataaaataattaacaaaaataaacgagaattatctgtatttttcatctgcaagacttaatgaggaagtttctctggattcggccagtgccgccacgcactcttcgcgtatggacttgatgtaatccagtaccattaacggatcgacacttttgccgtcgagcttgcaggaaatatgcaggtgttcaccggtgctgcgtcctgtagaaccggtaatgccgacgacatccctcggcccgatagcagcccctttccgggtaaggatacgcgacaggtggcaatagctgaccgtgtagtttccatgccggagggttacatacttgccggaggatttgtcctgcccgactttcactaccactcccgccatcatggccattacctcgtcgccccgcgcatggaggtcgattccgttgtgaaactttctttttccggtaaaagggtctttccgatacccataaagcgagttgattttcatccggcgcagcggatagcttacgctaagatagcgttctatccatacgtgcttgcaggtgtcggcagacaatgccggggcagcgtctcctgacggtggtaaggtgtcttggacggaaagcgtgtatccgggcaaggttaccgcattatccctaccggcagaaacgacttcaaccctgtatcggaacggcacggtcgaaaccgtattgaattgtgcttgaacggggcctgcgacacttgcagcacccgccatcaaaaacagtagtttctttctcatgcggcaaatataaccagctctgcccaagatgtcccgtttccacgacctttttcgaccaaagtacaacaaaaaaagcattcagagtatgaatttatgtgtaaaatcatactttgaacataaaaataaacactcttaatacactaatattattctattatatacagcgaaatgaaaagaatctatctttgcaaagtataattcaaaatacaaaatcaattatgaatacagtacgatttgaactaattgaattgccctatccgacactggcccgattcgggcttacacaggagatgatcgaggacttgccgatgcgtgtccttgatgagatttgcgacggtcgacactctcccgtgcttccggtgcgtgtccgtgacgagaaaggagaactgatagagagccgcagccgcttcgcccttgtccgcagggacgacggccgaccggacgtggtgttctatcccgttctggaatcctcgccgctggaacgctatgacgaggcgcaacagaaacagcttcttgacggcaaagccatcattgcggacgtggggacggcggacgggcggcacagcaaggcattcgtgcagatagacgagggaacgaagcaagtgatgtatgttcccacgccgattatcgggcgcaacctgcaagtgctggccgaaataatgcatctcggtccggtagaggtaaacggaatgcagaacggcgaaccgctgacgctggtcgtagacgacgaacccgtcacagtgggtatcgacctgcacgacaagaccggcatccgcttctgttcgggcgacagccaaaaatggaaagaacaacccaaacgcgagtgggacaaatacactttcggcgtgtacggctgctgggtgatggacgacgacggcaatctcgactacgttcccgaagaggaatataccgaggaactgtggaacgaacagaagaaaagcgccgagcgtaaccgtgcggcgggacttcacaaataacatcttaacattcatcaaatatggcagaacaccaatattatcccgaagaggtacttatcgagaagatggagcgcggccagtacggctggcttgactatgtgaatcatttctcacccgaatggcaggaggaatatacccgctattgcaaggagcacggtctcatggtgggcaatgaatcggccgccgagttcgtccactacaaggacgaacaactggaagcggcgatggagagcggagacgcataacggaaacctttttaacaacggattatggcgatacgaaagaataccaacccccgaatgatggacctgcaacccgaaatgcaggacatattgaggcgtaacggtatgcaggcccacgtggtcagtgacggcacgggctaccggctcgtggtacagggccacgactcgccgctgctgacctacgaccttaccgagcgtcagatgttggccctgacggactgggggacaaactcggccaacaagaaagcctacaacgtgttcacgagcattgtagggaaagacttttatatgcccaagaacttcgtccatacccgtaacgccaacggccgtgtcgctatgggattgcacggctaccgtatcggtatgggcgaatacggacgtgtgggacggctgggtatgccgcctccgttcctcggttggacgccacgccaccagtggggtttccatctgcggcgggtcggcggacagctgttctatccgggaccacccattgtccctgaacggtgggacgggcgcatgaagccgggcgaattgcaatcgggcggctacggattttattacaagtacaaggacgggcagcctatacagtccgcacgacagaccgatgtcctgcaggacttgcaaacggtcatcacgccgatagtcagccgtccgcgcagtacagaaccggcccgtacctacaaggagttgattgcttctccggtctatttttccaacgagaaatggcaggagtgtcttgcctcccacggtcttatcgtcgataaggaggcacggaccctgaccgtacagtccgaaaaggtggccgccgatatggtctatgacctgacgaaagaagaaacggccgtcctgacctccaactccatcgaggaacaacctgtcgagaaacgactggaagtcctgaacggggtaatcagggcggatttcgccgacaaggtaacaatggcggatctcgacagcgagcggcgtatcgccctcggcttgcaccccgaagtgcaggaggaactgacgcaacgccagcaacaggagcaggaaatcctctcccctctggaaaaccagctccggcaggagatgccgtatggcgcaaccgcttccgtcgatggacgggatatttccgtgctcgacgagcgcaagggctggtatcgggaagaacggcacggcagggaggtcgaggtcggcgaaatagccgtacatccatcccccatagagggcaagtacaagatgacggccgtcatcgacgggcaagtcatcactcacgagatcagccagaaggattacgataaattccttgcggtcgatgactaccatcgcatgaaaatcttttcgaagatattcagcgaggtggacatgaagatgcggccggaagcgcagcgcagtctcggcgtgaaaattttcgccgccctcacagcgggaacggtcatcacggcgggcgtcgtccacggcttgcggcatcatcatcacggtccggagttctacggcgagcgtttcggtggcccgccacacccgtatttcaaacccggtgtcgatacgccgagagacgtggccatacgcaatttcgaggcacagatgaatcaggatattaacgatatgagaagagggagataaagacaactatgagagaaggagaccttacctacgacgacttcctgcaaaggctgaacattcaggacgtgctgattgacgcgggctaccacctgaaccggcgcgacggcctgcgctatccctcgtatgttcgtatagacagcgagggacggcgtatccgcggcgacaagttcatcgtgacgcaacagggaaaatgctgcttccaagcccagcagcagaaagtctataacatcatctcgttcatcaaggagcacccgcagttcttcacggaataccgtgtgggcatgtcccccgaccgactggtgaacctcgtgtgcaaccggctgctgaaccatcctatcgaggaccggacaacgcggattatacagcccaagcgggacatccgcccgttcgacatcgcaaactacgacctgcacaagttcaacccgcaggaccgggagacacagaagaagttctatccttatttcaagagccggggtatcgacctctacacgcaatatgccttccaccgccacttctgtctggcgacgaaacatcgtgaggacggtgcggcatacaccaatctcgcttttccgctgaccttgcccaaaggcgacggtacggtcgtgggcttcgaagaacggggacgtgcaagaatggacggaagcggcagctacaaaggcaaggccgagggcagcaattcgagcgaggggctgtggattgccagccctgccaagaccccacttgcggaagccaagcgtatctattggttcgagagtgcctacgacgcaatggcttattaccagcttaaccagaaatgggacaaggaacttagaaagggagtgttcgtctctactggcggagcaccgagccagcaacagttcaaagccatgatagaggccactccacacgcttaccaccatctctgcttcgacggggaccgtgccgggcagatcttcgccatcaacttcgcgctcacccatgcgggcaagacattcaccagtaacgtgacgaaagacgacaaactgctggtccgtatcagtggcgaggagaaccaaaactacgaagtaaaactcgaacccttcgactttcacaggatagtcggcacgcttttacgtcccaaagaaatctatcgggaagatggtacgcttgactatcggacaatcggcgacggatatttgcaggagatgagcatggtgtgccaagatgagtacgagatggctcttgccgagggttcggccagtgaggaaacgctggagggcatgagacaaaatatcatggccatagaggatgcgatccgtaatcttcccgctcccggcgaggacagcaccgaccttatcgtgtacgagcccgctgacaaaggctataaggactggaacgaacagctcttggcaaaagccaagctgcaagaatcagttcacgaagagccggccagaagagaagaacccgaacaggaacggcaagcacgtttccaccgatgacaatgcggcacaccccacatgaaacaacaaaagagaagacaatgaatgacaaagaactgacacatgacgattttttgcaaaggctcgacatccgggatgtactgctcgatgccggttatcgccagaaccgacgcttcggtttgcgtctctcttcgtttatccgcacggacagtgagggaaagcgtatccggggcgacaagttcgtcatcacacagcatgggaagtgctgttgccagccaccccggcagaaggaatacaacgtcgtttcgttcatcaaggaacacccgcatctttttgcagaataccatgagggcataaatccggatcggctggtggaactcgtatgctaccgccttctgcattaccctattcccgaacaggaaacccgcacaggacaaccccagcgggacacccgaccgttcgacattgcggactacaacattcagaagttcgatccgcaggacaggggtacgcaggagaagtttgcaccctatttcgagaaaaggggtatcgacctctgtacgcagcaaacctttcaccgggacttctgtctggcgacccgacacagcgaggacggtcagaggcgcacttgcctcgcctttccgatgacgttacccgaagatgcggataagatcgtaggattcgagaagcgaggacacgcctacacggacggtaactccagctacgacgacatgaccgagggcaaccattcgggggaaggtgtatggattgccagtcctgcccggacagctctttcggaagccaagcatatctactggttcgagagtgccagcgaggcaatggcctactaccagcttcatcaggcgaaaaaccaagagctacgaaaggcggtcttcgtctcaacgggcggcgaacctaccgagaaacagatgcgaggcgtgcttgagcttacgatcccggcccggcagcatatctgtttcgacaccggtcgggaggggtggaagtttgcccaaaccctgcaaaaggaaatctgccgcacgatacgctccaccatcgaggagacaccggagcggaaaccatatctcgattccataccggacggcaatgatctggacgaaggagaattttatctgttgcccaaaggcggcttgcaagagagctgcatacgattcgatgccgaacgggaagaagccatatcaatgagttcgagcaggttgtgtgccccggaagatgtgcaggaccaaatagataccatgaggaagtgttaccgtgagttccgtgagaaattacaggattttctcggtatcgacaaggagcatgatgtcgccatttcccgtgaaatgccggactgtcgctatacaggctggaatgaacaattgctggcagagcaacagcaagaatcggtccgtgaagagtcggtcagagaggaagaacctgaacaagaacgacaaacacattttcgccgatgactatgcagcattccatacaagacgagcggaatatccttctgcggccgcataccgggcaattcgtcatcgacgaactgccgctgatgttcgtgtgcatggcggggctggtgtacggcggcatggaaggtctgccgttgagcagtatggcgagaatcgtttccttatttctgctcctcgtgttgctgtatcgcttcatctacctgcgtcggatacgttacagggtcggcgaagaacagcttgtcagcgaacacggcattttcatacgcagggtggactacatggaactgtaccgtatcgtggactttcaagaacaccagagcctcctgcaacagatttgcgggttaaagacggttcgcattctctcgatggaccggaacacgccaaggctcgaccttatcggcgtccgatgcggaaacgacatcgtggcgattatccgtgaacgtgtggaaatcaataaacgaaaaaagggaatctatgagattacgaatcattagtatatgggcggtcttgatacttgccggtctgcttccgcaactggccaaggcgcagattgccgcctcaaacccgctggaatgggcggcgttggccgagggcaatgaattgattaacggccagatagacaaacaaatcaaaggacagacgcagaccgccttgatgcaaaacagtatcgcagcagagttcaatcgcatacacgagtgggagaaacagtacaacagctacctcaagacggcgagcggctatgcctcgtcgctgaaagcctgcacgcacctctataatgacggtgtacggattttcctcacactggaaaaattgggcaaagcgatacggaacaacccgcagggtatcgtcgccagcatgaacatgaacaacctctatatcgagacagcgacggaactggtctccgtgttcacgctgctgaacgatgccgtggccaaaggcggcatggaaaacatgctcacgggggcggaacggagcaaaaccctgtgggctttgaacgaccagctcgcggcattcagccggaaactgcatctgctctatttgagcctgcgctattataccctgaacgacgtgtggaacaacataacggcgggtatgatagaccgcagcaacggcgaagtggcccgtctggccatgtcccgctggcgcagggcggcagccaccgcccgttgaaaaaaggacaataaaaaacgaagaacgatgaagcggataatctcgatatggattctgttgctgtgcgccggtatctcgaaggtacaggcgcagaacgatgcgacccttgcgggaatgattctggtttataccaacaaggccgagaaggaactgaaaaaccaagagaaggtcatgctgatgcaaaccacagggcatgtgtggacaaaagaagaagtggaaggtacgacggacttgcaacgggagttcaacaattacctgaactcgttccgttcgattgtctgctatgcggcgcagatttacggtttctaccatgaaatatcgcagcttacggacaacatgggcgacttcaccaaacaattgagcagacattcgacgggtgcattggctgtcgccctctccacgcggcgcaaccagatttaccgggagatgatattgaacagcgtggagattgtgaacgacatccgcacggcctgcctgtcggacaacaagatgacggaaagggaacgtatggagatcgtgttcggcatacgtccgaaactccggtcgatgaaccggacgctgcaacggctgactaaagccgtgaaatataccaggatgggcgacatctggcgggaaatcgacgagggtgcacgccctgttgcggacaagtacgacatcgtgaaagccgcccaaagacgatggcggcaaaatggaagaaatgttagaccctaaaaaagaataaaaatatgggagcttgggatacgatattgaaatacggcggaaaggccatgaaaggcatgggcaaggccgccaatgcgacgggaaaaagtgccggtcatgcggtactgcatccctcgcagacccttcggggagccgggcaggcggtcaaaatggccactaccggagctgccgtcggctatgtgggctgggaaaaactgaccaccgacaaaagtgtcgcacggatcgtcagtgaggccgtagtcggcaaatccgccacggatgcccttgcaggtacgaccgaagacatgaaggaactgaaagacaaagccggagagacggtctctgccataggcgaggctgtgggaggcgcggactcgaaactgaacggggtgtcgaacttcctgcgggaagcctccggcggtgggttgttcaacatgctcagcggctttttgcgaaacctcggaggaggcaatgtgtcggggttgaacattgcaggactgattgcggcggcgtacctcgtgttcggacgttccggctggctgggtaaaatcgccggtctgttcctgggcatgatgcttatcggcaacaatgcgggcgttgtccgcacggttccctcggaaacggtatcgaggacacagacgccgacactctctccggaggaacaagcgcaaagcggaggaatgagaaggtaggaacacataaaaaatatatatcacaatgaaatatacggaagaaatgatcctgcactcggacagcggttactgtatgccgttcgaagagccgcggggaaaagacgtggaactgtcgctcggttacggcgagcaggtacacccgacaacgggagaaaagttctttcatcacgggatagacttcaaagcgcggtactacatactgtcggctgtggccagtggcatcgtgtcgggcgtgggaaacgacccggtacacggcatttgccagacagtccgttacggcgggtacgaggtgacatacggtcttctgtcgaatgtgttcgcacaattcggacaacgggtgaaagccggacaaacggtggctttgagcggtgaacggctgcatatagaagtcaaattcaagggcgaggagctgaacccgatagagttcctgaccatgttgtacggcaacatcaaggctttgcaggaaaccgacggcaacggccctgcaggtttttacgatgcggaaacgggagtaaaaaacgactacgagaaggaccaaagggaaatagaagagctgatgctccgctttctgccgctttacatggaggatttgcagcggggagcgtacacggtgcccgcacatacggaacagtcgctccgccacatcttcacgatgggagcgatgaaagagtatttctacgagcagatgccgagcatagccaatcccctcggactggggcgcaaagccatgccgcttgcctgcaaagttcagaacctgctgatagcggatttcctgaactaccttgccctgcggcatgaggtgtacctctccacaatgggcggcgaggtaaaaaaaaacttcatgacgaagctgtagcgggctgcggactcatcgacccgctggcggagttggacatcgacatccagagtttcgacatatcgaggattgtctccgtctatcccgaccgcgccggagtccgctggtggacaaaagcatggttcaacaacagggaagaaggggaagcctcggtggaaatcgaacgggaacaggcggtacgcttcattcaagaccgtatcgaaaaagatgcatggctcgaagagtttttccccaagcaaatggaagtgtaccacaacgccatcgaacaaacgaaggaacaactgctgaaacagataaacatgatatagaaagatattgattatatggacgaaatcaaacatagcaggaggtttgcggaaatagagaccctcatgggcagttatttccgccatcatctcgtccccgtcatgacgcagacgcaaacctacctgaccgagaagcagggcgaggaaatgaaggagtattcgacttccataagcggcatactcggcatgatggcgtcggcgggccaaccgctctccgacccgtaccaaacactcaaggtaacgggagaatggaactccaaaacgacagaggactacatcgagatgtgcaataaacggattctctcgtcggaagaaatacagcacgatctcgcctacatggccggagagtggcgcgataccgtcgtgcaggaagtcggacgcgagcgttacgacgaactgtcgcaggaattgggctgtgacctcgcctacgttttcgtggactaccgcgtggagcaactgatgatagaccatctggtgaaggaacgtatgcccaagtcctcggcggactacatcatccgcaaagcggctgaatcaagcctgttggggttgcctcaggcgttgagccgctcgccgctggccgaagagatagagaaacgcggagaggccgcctatcgtccgagcaagttggaaaaaggagcaggttgggtgttgggggcttcagccgataccgtcatgctgggcggtgcaggttcgtgggcgagcttcgcacggttcatcggagcggatacagccatctcggccgttgccgatcacttcggggcagaagagacacagacgctctctgcagaggagtgtatcagcaagggtgtgttcggcagcgaaagcaatgtgttcgagggattccgtaaggaagcagcggcgattccacccaaagagaacacactcttggccgaagccaacggagagttacagaaaaagataccgattataacattcgattttatggattggtggaaaacagacagtataaatatgccgtggcgggaagaaactgccggggaagaacggaagcgggcggaacggtataaagatgtgccgatggtggtcgctcccggacaggaggaagcctatctgcaagacttggaaagagggaataccgaaacggaacaagccggtcaggaatccgaacagagggaaaaagaggcgaaagaagtgcaggtttccacagtctccaccgagaaaacgatacgggaagagccgtccgggcaagaaccgcagaccatacagaccaacgagaacggttgggatggactgacccgtttcctcggactggaaggtttcagcgaagtcatgagtaatccgggcagtgtgttggccatgctgccagacatgctattgggtatattcacaggcaagacgcaatcactgggactgaaagaaaacctgctgccgatagcgagtatcgtggcgggcatattcgtcaagaatccgatgctaaagatgttgcttatcggcttgggtggtgcgaacctgctgaacaaggcggggcacgaggcactgggaaaagaaaggacggagagaaacggaaatgtggccacgaccgacaaaaaggtgcagtacagacgctatcccgatgagccgctcaatccacgtattgtgaatccggtactgcaaggcaatacccttattgccacgatagaccacgtgccctgcacggtgcagcttaattccacggtggcggacgcctaccgtgccggtgccttgccgctgaacacgctggccaatgccgtgctcgtccaaagcgaccgacttcgccagatggcttcgcagaactatgacaacggacaacaggagaccatcgtgcggacacggggcattcagtaatatcatttcgtaaccgacaaaaattttggaatatgaaagagaaatcgcagatagaaaagaatgccgaggagcgacagatagagttgctctccacggctttgaacgaagcatcgaacgctggaggccactggctcaacgccgctggcaaaggttttccaaaattctacccgcgcggtgtcgccgtcagcccgttcaacgggttgtttatggcattgcattcggaccggaacgggtgcaagaccaacctgtttaccctttacagcgatgccaaggctcgcggcacatctgtccgtgagcacgagcagggagtcccgttcctgttctataactggaataagtacgtccatcgcaacaatccggaggacatcatcagccgagacgcctatctgaaactggacgaggaggtgcagaaacagtacaagggcatacataaccgggagatccgcacacttttcaatatcgaccaaacgacactgccttacgtggataaggaggaatacgatatggtattgctgaaagacggcagtgccgtggaacggggatattccgaggccgacgaacggcgattgcatatccgtttcaacgacttcctgctgaaaatgcgggacaatctcgtgcccgtgcgttcggacggaagcggaatgccccattacgagacagaccgcgatgcggtctatatgccgcgccaacgggatttcggacactacaacgattatgtacaggaggcactgcggcaaatcgtaagtgccacgggacaccagcaacggctggcccgtgaaggcatggtgatgaaaaacggtatgggtccctcggaagatgccctcaaacaggaacggctaatcgtggaggtggcttcgggaatcaaaatgctggaattgggactgcccgcccgtctgtccgacaaaagccttgaactggtggactactggaaccgggaactcaaggagaaccccaacctggtggacgccctcgaaagcgacgtgaacaacgccctcgaagtaatccataaggcagaacggggcgagaaaatcgaatatgccacgatgcgcaaccgccggcagacctcggacatgcaggagcagttacccaagcatttctatgtagctgacgagatccggaaacacccgaacaaggaggacaagaccattgtcattgtcatcgacccgtcctcgaaatcggcggatgtgatactccctgccggtgcgtcgccggaagtggacaatgaagtgccgggcatgaacaaggcccgtatcggcagggctttgcgaagggaagggatcgaaaacgtgcgtttcttcaatcctgacggcgcatgggggtataggcccgatgatacttatttcgcccaaaaacaggtgtcactggcccggctgaagaactgggcgctggagatgctctccacattggacgtaacgcctgcggtcaaacgggcggacgaaatcggcttcgaccaagtacagatgattcaggacgacaagaaccgctgggcactgtatctgaagcccgaacatcagagcgggtacagtatctatcccgacaaggacgacctgaaccgcttcttctccaccctcaaacagtcgatggacaatatcgaaaatgtacgcatggagctggcgcacaagtattatgcgctggcggaaacacaacccgacctgaaagtggacctgttcagcagcggggcgcaggacattgacctgaaccggattcagcgggtgtccgtgttcaagaccaaacaagaagggactctgtgcgtggcgaccattgacggaaagaaattacaaccccgaagcgtcacccggcaacaatggcaacgcatgtgggtggcggaggaccgtgccaaatacaaatgccatctggcggccacgcttttcgccgacgtactgcgcaaaggacagacgcaggaagagagtgccggaaagaaacaaggagaagaggatacccagcagcaggataaagacaagaatcctaaacaaaccgccggggaagcccagaaagccggttcatccctaaaagagttgtccataaaagatatgccggaacaactgtatggcaagtatgagcaaatcaaagaagaacaaccggaagcggtcgtccttttcaaacatgggaacaactattatgcttccatgtatgatgcggagaccattgcgaacgaactgaacctgcctccgagcaaagaacgcgttccgtatgatgcaaacaaaatcatattggtattcgagcatgacaatgaggaaacaaggcagcaaattcatgcgctacgggcatacgtgatggattgtgacggtatgtccaaggcacagcaaaacgggcctgcagaaacaaccgacgaagagaacgaacaacgtccaaccatgaggaggtagaaatatggcaaacaagaatcaagaatatacggaacaatatgcagactatgcgatggaacagatgcggcggtacggcattccggcctccgtgacgctggcacagggcatactggaaagttccaacggacagagccgtttggcgcagaatgagaacaaccacttcggtatcaaggccacgcccgaatggattgccgagggtggccggtacagcctgtattccgatgacaagccgaacgagaagttctgcagttacgacagtgtgggcgattcgtatgagcatcactcacgcttcctgaaagagaacaaccgctatgcccgttgtttctcgctctctcccgacgactacaaaggctggacgctggggctcgaaaaggcgggctatgccacgggcgggcattatgccgacagtctgcaacgtatcatcgagcagaacgggctgcaaaagtacgaccgtcaggtcatgcaggagatggaagcgcagggaaagcggttcggtgtggaagagaacccgctccgggaagccggaaatgcagtggactattcgtttccggtggaacggaaagagtttcttttcgtcacctcaccgttcggtatgcggcaagacaccaaggacgggacaaaacgaatgcacacaggcatggacatccgatgtaacaacggcgatgcagtgctggcgacggaacaaggcggcaaggtcgtcgctgtcggaaacaaatcgctcacggtggaatacccccgtgcggacggctgcaaaatacagtgtacctacaaaaacctcggcgaggtattcgtgagaaccgatgatacagtacaggccggaaatcggctcggtaaatcgggcaagagcggggaacacctgcatttcagtgtccggcaaattcatgcggacggtacgcaacgggacgtcgatccggcagcgtatctggctgaaatcgcacaaaagggcaacatcaaacaacaagtgttgcataacggcaacgacctgttcgccaaatataaaagtccggagaatgccaaggaaaacctttcacccgatgcatggatgaaaaaactgctctcctcggaggacagcggcgtgggactgtcagggtgtagcgaccctatcgtggagatggccatgaccgcttttacctccctgatgttgctggcgacgcaaatcgacagcaaaaacgaggaagaacaaaaggcggccatttccgaggcgatggaccgccgggaaatcgacctgacatcgctgttgcccggcatgaaaagttgcgacctcgtgatcggggaaaacgggcgggctgtcctgcaagcggacaacggaagcgtccaggtatcgcgggaactgacctctgccgagttaagccgcctgtcggtgacgcttaacgacggttctctttcggaagaagccaaacgactgcgtgtgactggactgttgaacacggtcatcctctcggaggcagcctcgctgaatttcgagcagggaatggccgagcaacggggacagacggaaatcctgaaacgataaaatccgaaagccatgataaaacgcgtgatgatacggttatgcgggtatctattcggactatccgtctgcgtcctgcacattctgctctgttacctgctgctgggctgggtgacaacgctcgtcgtcatgggggtgcagttgctgattgcagcaggattcatctacataaggatacgtgctcctgattagggccgccaccagtctgttcaacttcaattcataggaccctgtttgtcagatggtatatgtgtatcattaaaagacaaaagcaaaatgattaaatgtaatgttacggtatgcggcacgataggccgcaatgcttcggcgagaacaaacaaggaaggaaattcgtttctgtcttttccgctacgtgtcacgattccggaccgagacggtcaaaacgaagttatcgaaatcagtgtcagcaaagacggctcccaagaggaggcatcaggttatcggaacggttcgcacgtggagattacaggaacgctgtttctgaaacgcaggggtgacaaactctatttcaacctttttgcagaccgtatcgatccggttgcctcagacacggcggattttctcaaaggagatatggcatttcgcggtaaagtgggcaaaaatatcgaggaacggaaagacaggaacgacaaaccctacacgatgttctcggcattcagcatcaagaaggtcgatgagaatttcgagtaccagtgggtgcgcttcttctgcttcgacaggcaacgcgaagagtggttgcaaccgggtgtcaaggtagaggccaagggcgaactgacggtctcggtacataacgggaagccggacatctcctgccgagtggaagaattgatgcaatatgttcccgaatcggataactccaatcagtagcagtcatggccggttatagaaagcgaaatacagagggaccgaacagcgaggataaggcgctggacctctttgccgagatgatgatcgagaaaatcgaaagcatccagaaagattggcacaagccgtggtttaccgagggtgtactgcaatggccgcgtaacctgtcggggcgcgagtacaacggtatgaacgccctgatgctgctcctgcattgtgagaacgaagggtacaagattccccgtttctgtacgttcgactgcgtgcagcggctcaacaaacccggtaaggacggacaagaactgccaagggtatctgtgctgaaaggcgagaaatcctttcccgtgatgctgaccacattcacctgcatacacaaggagacaaaggaaaaaatcaagtatgacgattacaagaagctctccgacgaggagaaggcgcaatacaacgtctatcccaaaatgcaggtgttccgggtgttcaatgtcgcccagaccaacttgcgggaggcacgaccggagttgtgggagcagttggaggtagagaacgggaaaaggatcgaaaacggcgaacatttcagtttcgcgcccgtcgatacgatgattcgggataacctttggatttgtcctatcaaaccgagacatcaggacgaagcatactactcgattacgagaaacgagataatcgtgcccgaaaaagaacagttccagtccggagaagccttttacggaacgctgtttcatgaaatggtccactccaccggcgccgagggtgttctcgaccgcctccagccgacatctttcggctcgaaagagtatgcccgcgaggaactggtggccgaactcggcagtgcactgatcgcacaacgctatggcatgaccaagcatatcaaggaagacagttgcgcatacctcaaagggtggctcgatgaattgaaggaatcgccacagtttatcaagacgacgcttctggacgtgaaaagggcttcgtcaatcgttactcaaaaggtggataagattgcacaggagttggaacaaaatgttactgaagagcaagagaacaaacactcgaccaaggaacgtatcttttacgcatcggtggcttatctccaatccaccgatgacacgacgcaactggacgaattgaaggacaaaggcgactacaagggattgctggcactcgccaaggagtattacgacggcaacggtatggacgagcagcatacattcgcttctcccctccagaaccggggagatgatctgctaatcgaggataaagactttgccgtagtgtacaacggaagtgtcgggggcacttacgacatcatgctgaagtacacggaacaggaggtgcgagaccatatccggcgttacggaaccgaccgcgccagcgatgatgtgaaagaggtggccaaggatatggcggcggaagagtttgatgtcctgaaacatcagaaactcccgatgttcgagatgccgaacggaaaacatctgttcgtctggtataacagggaaaccgacacgctcaatgccggaccgtttaccggtacggatatacccgacagacaccgcttcgcttacaaccattgtctgtcgatggaagccaacctgcaaagcgtgaacgagaaactggagggtatggaagaataccaggccgaagtgcaagaggaaagctacatcagcggtctgcaccgataacggaaacgagtgtgaggtggcgttgaagtgaagccacctcacattcttatacattacattaagacaacagtttgtcaatcattgactgtagctgtgacatatcgcaatattgattgataccaccagtataatcctttacgtgccgggcagtccgtatcaggaacgaatcaagttctatctttaccccaccgtccatccgcgcatccgaagaatggcttatgtacacgaatttaccgttacgctcaataaagcaacttgtaaggtaatgccccttgctctcggctacaactgccgcatccacggcttttgcatatttggatatttcactcaacaacgccgtttggaagttattgtattcctttgatacataattccctgcatctgcaaggacagaagattgccatttggtataaaaagtctgtgtcatattctttcaattctaattctgtaaataaattaggcacatagcaataaaagcattgaatttatagtattcaattaacgacatttaagcaattaccatgatgttttcagagaccaaagttacggagatttatcgtatagcagatgatttttgcaaagaaattgctcaatttcagggaaaatatatggttgaatgaatattccatgccccgctcctttaatacaactttatttccaactccctttctaccataacaacatactgttttttgaaagaagcccgccattgatgtatgtttttcaaagacgggcaactggctatatttgaattatactcacgttaaatagctttcccagttctctttgtcgatagttaatttgttcatttcccaatcgtattccacttccggcatatcagcataagggaaatacacggtatagcctatctgtccgtaggagcaatgtaatggtatgacgcaaatatcctgaccacagtaaggttgtggcgtacaatatttcttccaatcaaaacggcctgcaattatattgcagcagagtaattttagagccattatacctttccaactctgaaaatccgtcttacaacttgtcctttccataatgaatatcatttaatgtgctatgttataataaatttcgggttcgctcgatacattgtagatgtaattgccacaacgtaccaaaagggcgtttttgccataatacagttctttcattccggtgatgcttcctgtcttgtggaaatttggaaagcggcttattcctgtcctttccgcatcttttgtgtaaagtgttttcattctcatgctattgctttttttaatgtttcatacagggtttctatcattttctcggcttcttccatatcggttacgatgtctttgatgtggtagggcgcaccgtttttgccgtgcccgtcattgcctatccacaggtaggtttcatagtcggggtcgaagccttcgtagaaattttccaattcacacagaaacctgtcgaaatccccgtctttcatttcaacagagacgttgaaatcctgccctttgggcgtatattgctgaaaatcgaacaccactctattttcgtacttcgttgtcgatgcttgccagcccaatcctgtggctactgcgataatttgttctgttgttgtcatcgtttcgtttttttatttccctttgttccgagcttttcagcccgccgcagggtcggtttttatgtgcgatacccgacggcggaagcaagaaccgcaaacaaggaaccgccgatgaaattttatgaaataccgggatctgtgatttcggaaagttttcgtcaaatttcagcaaggtagctctgcgatacttggtcagccgttcgtccgccgtacctttgcacggtaaaaacagcctgtggcggtgacgggcttcgaggaaatgataatccgacggtataaaagggagaagcaaactataaacgtcctgcctgctcatggcatataaatggctgattgggctattcaagtgaagatagctgcctacaaaagtatgcggcaacggccggaatataaacaaccacctgtcccgattggcaggtggttgaccgacagcagccggtatcaggcggtcatacgttttcggacaagtgcgatgttcttatgcacaaggttcataatccgtttatggtatttcgtatttttgttacacagccctctcgactgcagcaccttgaatgtttcgaggctcaactctacggtctcgaccctcttgttttctatccgtgcggagaataccagcgtattcggcttgaggtaatactcgcactgtcctacgcagtgatgcaacgcattgccctcgtcgtagtaggcttccacgctgtccagcacacggacgactatcgtcccgtccgtgaactccagaccgaagaacttgcctttcaactccctgaaacgtgcctcgttttcccttgcccgtttcatctgctccatgcgttttttctgctcttggagaatacgcaccttgttctggtacttgtcgtgttcggctttcaaatcggcagggcaaacatagtgggcgttgtgcaagtctttgccgcacctgtcgagcatacggagataatctgtccatattcccatgtcttttatccgatacttctggcgtaacacgattttgtaggacggccaacagaaatccaaatcctgcgggtggtctataaaatacttgaggtcgcgtttgcgtccgcttttgagtatcgtttccacacggctgtcagacagcagagctttcatcagcttttgcggggcgatgtcggcgaacgaacctttcaaaccattgcgtcgtaatttcggaatagatgtatatctcggataaacgtaacaatccgcaatatatttataaacatagttgtcgttccgcagttccaatcccgacccgtacagaaaacaatccaagtaacgtcccattgcccgttgtaaggccgtcagagcagttttaccgttctcgtccaaccaatacctggccacttcgcacacgtccgtccgagctttccggctcttgtgataataaacggtcattctgaaaatccgctgtacctgaaatccgtcctgtgtggtgatgacggaaaaataacttttctcgtccgtcttgcggcaaagcgtgtctttgagcgtcagtttggcatggcagttcggacaatggcaatgtttagttttcgtctcgttccaccgatacccgcaatcgaggcaggtcgtttgtccgctgggcgtgcgaaaagcgtaatgtccgacggtatgacggaacgcccattctgtttgcttctccgtgataggcagtaaccgcctgttggcggctactaccttatgttggaatttcgttcgtgctttcatggtcagaaatcgaaaagtgaaagttctgtttggttgctctgtgcggctttggcagtcggcttcggcttgctgtggcgttgctgtatcttgcgcatttcttcctcctgataggctttcagcgcctcctttcgtgcctgtgccttttcttcttcggtcagttctactttgtggttgaccacgacaccgcagctaatggggtttcctacgtcgatgttgtcttcatcatagtaatgaatggcgagcgaccacacctcgtcgtcagtcattccgcaacagccgcttgcctttacttgattgagaataaacgtgatacaatcgtccaagttcttgttttctttggcataggagacagcaaaaagttcgtctgtctgcgccctgccgtccaagtattccttgatagtctgtttgaaatgttccgtacctttcatcgttttgcattttgaggttaaaaatgatagtcgataacaccgccgatatagagtagcgtgccgggttcaaattcgcatacctgccgcaggaactcgtaggattgctcggcgtgggattgcaatccctcttcgtccatgtagaaccagtaggcggtatcgagcgggtttttcagaaatttttcaagctgatagaccgggccaatccattcctgtacgctttcgggggtaatggcttccgccctgcttcgaatgtctgcgacaaactcttctctccattgtgccgcaccgccattgtagcgtatggtatcgtcggaaacaagttcgaacatgcctttgggcagaatgttgtttaccaagttgtcgatatggtactggcgttcttcgtcgtcaatctcggcacaataatcgaaaaagctgtcatcgccttgcatgagggtgtcctcgttcatgtagtcgtccttgtccactcgtgttcgagtaatttgaaaaatcttgctgtgcataaccttgaattttaatttgttgaacttgcttttcttttccctcccttcggaagcctttcggctttccttgccgggagagattttacatgcaagccagacagcggggaaaggacggaaaggcaagcaaacggccgggaatttcacggaatacccaacccgacaggcacggcatgtcggggaactgaaaggccatctttgatttgcggaaggctgccgggcaaattcaagagccgttagcacagtggtgcttgacgccggacgaccgctgtacctttgcatgggaaaatctaaccggcgagggagcgacgacaggatagtaagaggaatgtaatatggttagaataaccacataaaaaagtggcaaattgtttgtgaattgatataaccctgttattgttaaattctgcgtaccattttgttgtatggtaataaagtagtatttgcataaaattaatgattatggttataacgattaagaatattccggttttggaaggtgctacggcagaagatttcgtgcgtaatgcagaaaagaatgccgtaaaggtaactccacagttgtccgtggcggccaagaaacggctacaaaaggtattggagaaatcccgttcattccgattcaactaacaatggacgggatttctttatacgatgattgcgtcatgcctgcctatatagggaagtgcgggaaaagtgtctccctttcacttgcggcgaggatgatcttgatgattttttccttcatgatgccgatttatatgcggatgaacttttagggaaaacttattgttgggtgacgactgaatttccgcaccgtattgtagcgttgtttaccttggctaatgacagcatcaagaccaaattaatctcttccaatgacaaaaatcgtttgtaacgtaatatcgtaaacccaaaacgtgggcgtagctacccggctgtactgataggaagactgggggtaaaccgggaatatcagggcacaccgagccatgtaggacagcaactgatgacctttataaaagactggttccgtcacgaggacaataaaacgggatgccgctttatcgtagtggatgcgtacaacgaggaaagggtgcttaagtattacgacaaaaacggctttcttcctctatacaagacagaagagatagaaaagcaatatttatgacattccacaagacgcacctttgaaaacgcgcttgccatataaaggactgatataacttgaatttgacagaaacggtctcggaataatcattcgaggccgttttttatgtgcatattatgcagtcgccaaatgcggtcataaggttcaagttatataatttactgaatagcaatttcttttctaatcaggaaaagagtttattgatagttttttcgtatatttgatgcagttagaatatatttaactggctattagtagattgggaagaactcacacgagaacgggcaacggataagaaattggaaagtgtttagaaccactatatttctcaatactgtcaaataactcttaatctgaggcaaaaataagtaattcaaacggaagaaccaagagtacaagcggtaaaaacgaaaaaaagtaattacttcatgaaagacttaatcggaactattcgaggaaagggtattagagggagaatgggaggtaagtaactgtaaatgagtgtgattatcgctatatttcggtggtttgcacagaggggtaaattagaatttcagaactactgttttatctcacacacccgtttttgtagaaatcataccatttgtcaatctgctcggggttgtcggctcccagtaacagaagcatctcacgggtaaattccaagtgtcctacaccgtttgccgtaacgatgttcttatcactgacagcttgtgcttccacataattttctacgttagtataaactgtacaccccattttttgagttggtcaataccgttgcccgtatgctttacatggttcagaaaaccgtgcgaacacaagaacgaagcaccgttgcatatcgccccgacgattttgtctttatccaaagcctcttttaccaatggggcgacaagttccgcttcgggagaatcccaacggttgccgccgataagcaccaaggctgcatagtctttcggcatattctcaaaagaataatcgggcaaagttctgaaaccgccgataggacggacagtgtccaatgtcggtgcaacggtatgcacttcgtacttgatttcaccatccggtatcacggccacatgaagggccgtggagagaaaagccccccagtctgcgtacccatttaacaagacaaataaaactttctgtttcattgatgtatctatcttcttagtttaataacttcgccgcaagtttgtaggtaaagagaattcggggattggacaactcccatcgctgaacctcatcccgtatcaattctgcgtgctccttgcttatgtctctcaaggcatttcccacggatttccttaaatacttgctttcatgtgccttgtgcttaccgatcaacgcaatggcaattgacggattctccttgaagaacggacgagttgtccaaatcctcaacccttcagttacggcacggataacattcggattgtcgtcattcagccactcttcgatgagcggtaaagacgcttcatatcctctatacttgcaaacttcatcgaaagccattgcaagcatttcctgtacacgccaattcttgtctatactgaccgtctctttcagaaaacaaagagcattattattctctgttgccaatctacccaatagcgttgtcgccagcatcctgaattggtaggcttcatgcctgaacagttcgagggcaagttcaaaaaattgtttcctcgggtatgcggaaaggatttcattagccccatcaaggatgtggtgaaaaccatgctctatttgccgtatcttgtttaataagttatcgatattcatttgttgagtgtaaaattcttcattcttccatttttcttatcgggtgccggatcacagtccttcgcttttcgggagcgactttccgggcgtcactgagatagatttcatgatgcatgcgcttatccgtaatgtcgaggacgtagccccggctcttcatgtattcgtgcataagtgcgacagtaaccggctcgtcatcataagaaccgacatgcatgcattggacgcataagccctcatcacaggagagaaactcaaccttggcaaaatcggttttctttttcttcgttgcttcccggattgcccactcgaaatctgcttttgtcacaaagtccggaagacggatgaccgatatccacttgaagctttcctttcgggcatagtcgatcccttttacgccatcctgccaccagaagccttcgagcggcggcacgacataatcgaaatacccttcgatccgatgatcgcctttttggctcattttgatggtaaacgcgattccatacaaaagcccgatcgactgtttgtattctccctcctctgcattcgggtctccctgtcctcgaacggctatgtagttcatgcttggcacggtaatgataccgggcttgctggggggcatatagaattccctgtattcttttttgtagtcaaaagccattggtttattcctccatcttatctatttgttgcttgttttgatatgcatccttatcttcctcatcgcccagtcgtaatggcttgccgttgtcgaaacacagtaagcaccgagtgtggaagtggaagtggaagtgccaggccaatcgaacgcccccttgacaaagagttcatcgttggagaattgccctatcagagtcattacctccttgtgactctcttttaagttcgcttttgcttgtgtcaatggcgtgctttgatgcttcttccaaaactccacgttcattgccgggtatgtgttccagttgtacggttcgggcaggacggttttgtacccgccgtcaagcttggcttttatccaccttagtagcagttgatgccactcgtactgatatacaagcacatcacgcaggttcctgtccctgctccaatgtgtttctttcccggccgttgccatttcgtcggcaaaggctgccttctgccgttcttcgctcatactgtcgatgagtttccacatcttgtcgaattgtccgttggcagatgttatcaaatccccttttgtcgttgctcttgccatagtcgttattatttatcatagagttccttgctaaaactccggcaatgcccgttgggggcttcaaaagtcagcaattcgccgtatagctcttctctgatgttgccgatgatcttcacatttttgcttctcaactcatcccggacaagttcgatatcctccgcctccaacataatccttgtcttgccggcaacaacttcaccttttctctccggttcttttcaggatggcaaacgatgtctcgcccaaatcgaactctatccggtcgccatcaatggcttttatctcaaaccctatattgcgatagaattttttcgaccgttgcaaatcactgacataaatccaacaggcatatattttttaatcttcattcttatcgtgttctttttccgtactccgtgcaaaccttgtcgtgcaatgagacaatgccgccacattccgtgcaggtgtatcgagcggggtgtgtttccatgaaatgaaataaaataccccgtttccctttacaatctcactattttcgaccggactttccttgtaacggctgttgtaacttctttcgaggtttcttataagtctacaagggaagtcgccacactgatagtaataagtaatctctttcagcagcacgcagtcctttatcctgccttgcgacaatgttccggtctccctttgccttcccgcgtacagccgacgcaagttttttgcgttttccgtgtatgacaatgcttatggcagaccatacagttcataccgcagggagcgagcatttctatgtcaatgcagtcaattcgcatatctctttccccatttattctatgctgcaaaaataataattttctttgtaccgtcgtgcttttattgttctattaattcctgtatctcgttaagatgcaactcaatatgtcccaaatatccatcaatcacttggcgaagagttacagcaataccctcgaaattctgccatgaattttcaagcttagtatggtcaaccgattttatcacttgaatcatgtgcagattgtaatacttctacaactgaatcgtaatattccaatcagcattttgataatcctgtaaagcgatccacaagtcattatcctgttgataatcgggaaagtcaagtttatcgttgtactgtaatcgaaccacgcgttggtgattatttgcagcagaatcaaccaaatgatccagtatctgtttgatagtcctgttttgtttattcctcttttttgtaattgtatcaactggtaaatcaatcaatttttgctcccaagtatcaatataccgtagaatcccatttgtaacatttgaaaaatccatttttattatttgttttattgagtcaaaaacagtaaaacattcaactcctcaacgtcaggcaaatcagatgagtttgtactttactctttgcgatgattattagaatcgtcttcatcctaatttcgttgcacttcggtttctttgcatacgagacaacatgagctaggcacagttttcaccttatatccaattcgcttgattaaaaatcacaaatcttttagcagaccattctcatcgtattcgaacataggcccccacaccacctcccaataatacccgtcaagatcggagaagtaggcatgataaccgccccagaaagtttccgcgggttctttcgcgattctgcctcctgctttgcatactttttctataaccacatccacctcttcacgtctttccacattgtaggcgagtgtaattcccgcaaagccctcggcaattttcggtggattcgtttcactgatgtctttggcgagcagccccagcggataaagctcaaacttcgtacctggtgtattgaagaatataacctgtggttcatctcctttctcgcaggtttcgaaaccgagtccatcacgataaaatcttattgcaaggctcatgttgcggacaccaaggcaaatacaagtaattttattcatattcacatgatattttagttattgtgtgtcgaatctatactcctggagttaacagtatttcacttgtttatccgtatatcaggatcgaaactgtagtttcgcttgccctctataaccgtggcttgcagaaatagtgccctgaaacggtcgaatgtgtttcttgcgacgccgtacctcccgcatatcatggcgatcgtccgcccgtcatttaacaagccggctatttcttctcccgcgtcgatcaggcgttggagcttggtatagcttcccctcctgcgacccagtatgacgccttgttcccgtcgtgccgccagggcctctttggtgcgggcggatatgaggtttcgctcgatctcggccaccaggccgaacgcaaagcataacaccttgctgttgatggtatcgtcaaaagaatagcgatccttggtactgtacaggaacacgcctttttcgagcagttcccccacgatcgtcataatatcggtaagcgtgcggcttaacctggaaagttctgtcacgatcaacgtgtccccggcttttaaccgctttaccgttgccccgagtttccggtcgcgtcttttcttgctgccgctcacgacttccgtgacccagcaatccaccaccatgtttctactaccggcaaatctcgtgatctcgtgtcgttggttagtcagcgtctgccttcccgtgctgacccttaaataagctactaccatagtcggaaaaattaaaaaagcacgaaattgccttttcccgacaattaaactggtggatatcctttttcaacatgcgctgtttgcgaagtccggtagctatcttaacggcattcttcttcaggcaaaatcctatcttatccttaatctcttgtgtgagccggcgaggacggcgtctggaactgtcatacctgggctggatggtaagcaaatcactcaaagcctcttctggattgtccgtgcggatggctgattcgtactttgaaagaatattgtcaacggtatgacggctgacatgaagttcacgagagatacgccgtttgctataaccgcatactctatacatgtgtattattgattgtctttctaccatagtcttcattttacctttgcatttggattatacaaaggtcattatacttatcctatggtggcgcaattttcaactggaatattggcgcacttttcaattagtatctacaggcataacctttaggggtacattctaaaaggtgaagatttaacctttttattatttcttaacactcaaagagcggtggtagagggtattttccctcttttcggtactttattgatggttcgatgttcccatctttccacattgcttggctcgttcgcacaagccactacaaaggtactacaatttccaataaaggcaagaggacagcaattcaaatctattatttttgagggagtgaaatctgccgcttgccaaatttctctctgtcgaaaataatagtcctctgaaaagaatgaaaacagcattgataaaattgccttattaagggggggctatgctgttttatgctattatttcgtcagtcgtttatctccgttgccggatgcagttttcagccaagccgatgaataagaaaaggttttggagctgtttactctccaacggaggacgaaactgctccaaatggtttaccgcttgaacttttcgttttctaaaagaggtttggcaacctttgcatccgacaaaaggagataaatgaccagatatataacagtagtattacattaaggtaaagaacaaccatggtatagtattattgcaatttaactatttaaagtttgtttataatcaaatcatttaaagatttttgtccttctatgattttttgtatttgataaatgtcgtaattaaataaaaaatatcacgcataatgactttttcttttttctaaatttcttcaaatgacaaattattgttacctttgtaatgtaatatagttaatggttgcgcttataaagtccttggaaaggatttatgtataaaagaggtagatgtttactctgttcttgcctggattatcagcatcactgatatgaaataacagaaaaaaatatacaatggctaagcggacggacaggcagggaaatagtacagattcccaatccccctctttataatacattgcgtataagatttattaactgtctggtctggggaatctacagagatttaacgaatcaagatgggaagagtcagtctttgtcttgtcataatgttcttcatctgtagtgctcaaaaaattgatgcacaagtacagaatatcagagagaaacaagataccatttcggcgactaaatcattagagcatatcaggcccgagaatatcaagaagggaccattgaataatgctttggatgtattgagtggtcagtctgccggtgtgaacgtcaccactaatgggactgacaggctcgctatgctgaatagtatccgtgtgcgtggtaccacatccattatgggtggcaatgacccgttagtaattattgacggagtgacatctgacatcgctacgctatctaccatatatcccgcagacatcgagagtttcactattttgaagaatgctaccgaaacggcaatgtacggttcccgtggtgcttcaggtgtaattgagattaagaccaagaaaggaacggggcgaggtttcgaaatatcatatgatggcaactacggattcgagtcaatgtataaacatctgcaaatgctcaacggcccggagtatatagctacagcagaggcacttggattagattacaataatggtggctacaacaccaattttcacgatgtaattactcgtacgggcttgatacatcagcatcacttggcttttagcggtggttcggaaaactcaaactatcgagcatcgttcggttttatggatcataatacaattgtcaaagttaacgattaccgaaatttagtggtaaaacttgatgctacacaaaaggctttcgatggtcgcttagttggcgattttggtgtatatggctactcgtcaaagatacacgacattttcgatacacgaatgctgttttactcggcagctgcacagaatcctacatatccagcaggaactgatgttaatggcaactgggtgaagaactcggctgcatcacacatcaaccaccccggagcactcctctatgagaaaaatgactccgaagaacggaatttcaatacacatttggggctgaaatttaatatccttgacaatttgatattgtcggctttcggctcttattcatattcatctacgggaaatgctcaattttgtcctacatgggtgtgggcgcaaggcaatgtttatcgtggagagttcaagggtgaagactactttacaaatgtgtccctctcatataacaatgcttggggagactcacaccttgatgctgttgttggcgcagaatatcttaaacaggtaaggactggtttatgggtgcaggcaaaaggaataacaacaaatgatttctcctataataacatcggagcaacatcatcgcgtcctttcggtggtacgagcagtagctatgaagacccgtcacttgcttcaataatgggtagtgtcacatatagttacaaggatagatattctattgcggcagcactccgtggagatggctcttcaatggtaagcgataacaatactttcggattcttcccatcagtatcactgggttgggatgtaaaaaaagaaggcttcctctctgatactgactttataacaatgttgaaactaagaaccggatatggtcggtcaggaaatcttggaggtataacatcctatacaacacttaataccgtaaaggagaatggtatcgtatccatcaacggtgcacctaccgtaacaatgggaagtatacgcaacacgaatccggaccttaagtgggagactcgttcaacatttaatatcggttttgacttaggtatatgggataatcggttgatgcttacctcggaattatattactcaaagacaacggatatgctctatgagtatgatgttcccgttccgacctttgcgttcgataaactgatggcaaatatcggctcgatgtctaaccagggtgtcgaactaggaatctcggtagttcccattcaacgaaaggatatggagatgaatatcaacttcaatatgtcctaccagaagaataagttactttcgcttagtggagagtataatggtatgcatatgacagcttcagatattactccgattggctcgctttatggtgcaggtcagaacggtggagacaataatgtagtatatcagattgtaggtcagccattgggggtattctatctacctcactgcaaagggcttaaagaaaatgaacttggtggctacagttacgatattgaagatttgaatgatgatggcgagattgattttagcgatggcggagacaggtatatagcaggtcaggcaacccccaaggtaactattggatcaaacatcagtttccgttacaagtcctttgatattgccatgcagataaatggtgctttcggtcataagatattcaatggcacgggcttggcttataccaatatgtctatattccctgactacaatgtattgaagggtgctcctgaaaaaaatattattgatcagaatgtttcagactattggttggaaaaaggtgactatgtaaatattgaacatattaccataggctacaatattccaatgaaatccaaggctgtgaagtcattgcgtctttcggcaggcattagcaaccttgcaacaatcacaggctatagcggtcttactccaatgataaacagttatgtagtaagcaacactttgggcattgacgacaaacgcacctatcctttatatcgtacctattcgttaggtcttagtattcaattctaaccgcttacagttatgaaaagatatataaacatattgatggttgctttggcaacgatgatgacctcttgtcttactgaagaccctagagatcaactttatgaagaagacatttacaacaatgccaacaacatatatattaatgcagtggctgtgctctacaattacattggtggcagtgcagacagtgagggtttacaggggacctgtcgtgggatttatgactataacacacttactacagacgaagccatgatacctattcgtggtggcgactggtacgatggaggtttgtggacgaatatgtatcagcataagtggagtcctaatgatttaccactctacaatacttggaaatacctctacaaggttgttgtgttatcgaacaaatctctgcatatcatcgataagtatagccataacctatctgaggagcagagagtggcctacgaagctgaggtgcgagctctgagagcacttttctactactacattatggatatgtatggcagagtgcccatcgtaacatcctatgaacaaccgcaggatgaagttgtgcagagcgagcgtagcgaggttttccgttttatcgtgaatgagttgcaggaggttgccgagttgttgccaaatgagcgtagtaataagatgggtaactactatggtcgtataacaacacctgtagctaatttccttttggctaagttggctcttaatgccgagatatattgtgatgataattggactgatggcgttccacggaacggtaaagagatatttttcaccgtcgatggtgagaaactcaacgcttggcagacctgtatcaaatattgcaataaacttgccgaggtaggttatcggttggaggacgattatagctataatttctctgtgcataacgagaactccaacgaaaacatattcaccattccgttggataagaacctctatgctgcgcagttctggtatctcttccgatcacgacactacaaccatggcggtgcgttggggggctcatcggaaaatggtaccagtgccaatatctcaacagtcttagccaacggatacggcacagatgatgtagatgctcgctttgaaaagaacttctatgccggcatcgtagaggttgatggaaagcctgtaatgatggacaatggacagcagttggagtatttcccattggagctaaagttgaatcttacgggaagctcctatgtcaagacagctggtgctcgtatggcaaaatatgaggttgataggacctcacattccgacggtagacaaccggataacgacatcgtgctattccgctatgccgatgctctcctgatgaagtccgaggcaaaggtacgtaatggtgaggatggctcgttggagttgaacgaagtccgaggtcgtgttggtatgccatatcgagaagctacgcttgagaacatattgaaagagcgtttgttggagttagtatgggaaggctggcgacgacaagatatggtgcgttttggagtttatcacaaatcatacgatcagcgagtccaactggctgatgagaaaaatgggtataccacagtttttcctattccacaaaaaagtatagacttgaacccaaaattgaaacaaaatgttggatataaataactttagcctatgagtattcaatttgacattgcaaaacagattatagctgaaacatgccctaatcgcaaacttaagttggagaatattcgcctttttgcagatattattcagcctaagaaatatcaaaaaggtgatataattctaaatgaaggtgatatctgtaattgcctattttatatagaaaagggatttattagacagcactacctaaagcatgataaggatgtgatagaacatttagcatgtgaaaaagatgttgtctggtgtattgacagctattttaaccgagagccaacacatcttatgatggatgctgtagaaaacagtgttttatgggaaattccgcgtgatataatggaagaactttctgatgctaatggtgatatagcttatctatatcggagtttttttgaaaattccttaatgttatcacaattaaaggctgacattttacgtttcgaatcagcaaatgacagatacgctagattacagcaacattttcctgaaataactagaagagcacctttgacaatgattgcttcatatcttcagatgacattggaaacattaagcagagtacgtgcatcaatagctaatgctgagagcaaataaagcaaactaactattaggacttaactaacatcaaaaacaggtcaggatatagcgtcctgacctgtttctttaataaacttaaaagctatggattaatgagatgttagtcatcgtcatcatcatcgaattcatcctcatcgtcgtcatcatcatattctattgcttcactttcttcaataatgttactaaaagctcctgttaaatcaaaatgatagttctttttattgttaaaaaattcatacgtgatagagccgaaagtattcataatatgtaactgatgtttatgactcactcatcttattcgaaaaataagggcaaactaaaaagtgtatgtttactatattgaagtcatatcttttgaacgacaaaaagtaaatacttatatagaacaacttccaacataataatcactttttagcatgccgcatacattgttaaccttaaaaatctttttacctgttgcaagtaaatcttacatttactatgcataaactaaaccctatttactttcctctcttgcttgactttaaattataaaagacagggatcataccagtggggcacacatgtaccttgcaaatttacacacctcatttttatgtaatttaatatatcccacttttagcaggatattactttacagttgttaactcttttaaagtgtctgtatcttcactccgattgctaaaaattgttttcctgttttccatccgatagctgtttcttgacagttgtataatctcacaacagtagagcagtctgtcaagcaatgccgctgcgacagcttcctctcccggtattgccagccactctgtaagggagtagttggctgtaacgataagcgatgtcttttcctgaaactcattcaccagtttgaacagcaacatgatatcttctcttttcaagggaaagagtgtggcattgtcaatggccagcagctgtgccttcatgatccgtttgtaggttttcatcgcatgcctggaaacatcccttgtcttcagacaggtcagaaggtcctccagcgtaaccatatatgccctgtatccggctttcaccgcctcatggacaagtccggcggcaatataggtctttcctgttccggaaccgcctgccagaagcaggttgtatgcctgtcccacccataccagctcgcgcagttcgcgcagctttctggagtcgattccttccgtccgggtaaagtcgtaacggtccagatcatgccttgcaggaagcccggccgctttcaaacgacacaaatatttccggttctccctggtccggacctcctccctgaggcaggcgagtagaaactccggataggtcagctgcttttcctgggcctgatgcagcagttcctccagatgttcggtcagattgcccagcttgagcatacgtgcacattccatgagttccttcttatgtcttgtcataatccctgagtatttcgttataagactgtatcaatccgccttgtcggggcaggtgatcctccagtccgtatatttctgttccattttcctttcccctgcacacatattcacacaggcttttaaccgagtccccgttatagatgcctttgtccagacatatccgtatggcctctatcagtgtattcttgtcatatccgggaattatgcgcaggatcacctccagattatccctgtaataaacgtgagttcgaaataaaatcaaaaaatagcaagttgtccgtcattgacaaactaagaagaagacagttgaaataaaaaagagattaccaccaaatttgacgaagaaccaattttatttctcacattctcatagattccagataaagcactcgtaatcaaagaattacattatgagaaacatttttagaacaggtatttctcatactttcctcatcaatttccttcaaaaaaccgctatttctcatactctttcaggttatttctcatagtcagatacagctattctcctatttacccaccaagcttatcttacaaaacatctagctatttctttcatgtaaacaactagttaattacttgtttttcacctaataatgtcgtatctttgaaagaacatcccaatcgtcccactacagtgcacaggcctgttcactacagtaaaaagttctgtctactagagtgaaaagaaccgttcactgtagtggaacaatcaggatagcggttgaataataaaagaataaaagcaagatacaccaagagcatcagtacataacatataaataaccattaaattaaaacaaagatggcaatacaattcgagttttataagaatccccaaccggaaaaagaaggggaagaacctagttatcacccacgggtggttaattttcaacatgtaaccactcaaaagctggcaagagaaatccacatggcaactactttcgggaaagcggaagtagaagccatgctaatggaattgagcagatgcatgggcaaccatctgtgcgagggagaacgagtacacctggatgggatcggctatttccaggttacattacaggctaccgaacccgtgcactcacttaccacccgtgcagacaaagtaagattaaagtccattaacttccaagctgacagagatttaaaaagtttgtgcatgagtactcatttacgacgttcgaaatacaaaccacattccgcttctctttctgaagaagagatcgacaagaaactcactggatattttgccaatcaccccgtattgacccgttccaatatgcagtcactctgctgtttcactcaaagtatggccagcagacaaatccgtcgcttaaaggcacagggctacttacagaatataggcaagcccacacagcctatttatataccaaccccggggcattatgagaaatgagttcaacgggtatgagaaataagccaaatgaaggctaattcgtgaataaaactatgagaaatgccgattttcaaaacatttctcatagtttattctattagttatctggcacttaggtcatatttatgagaatatgagaaacaaatattttatatccattctgacaatgtaactccagctcgcgtgcaagctcatagggaatatccgaaaagaaactttgcaagcgacggaaaaaagattcataatcaccggcacgcacttcacgaacaaatttcagaatttcaaaaggagactccaccttattgacgttcgcataataaggaaggagaaaacggataaatccttcctccacttcacgattaggaaaacctaaacgatatattccaaaacgctcatcatgccccttaatggtgaggtatccgctctgataaatcaccgggataggattggtagattcggcaactctactctaaccttaccatcaaccgcttatgcacgtttatttacgccccagacattataagaaagaatatttcctgcaggttccccgtcaatacaggaagccgacaatccaaatcggcaatttacacctgtaaggcgtttctattccatcagctaaaatataagaatcaggcacatctgcaatctgatcatacgttttaccttcaccaccaacttccaaaatatatcttccattgaccctaaaatctccggttttcttcccgtactccacttcattgtcacacgaaagttgattgaccacaaacgtttcacgtgccgttcctattttcacaggatgagaagctaaagcatatagcagattaggattatccaggaaaatcttatccggcttttgcatcttcttaacagacaatagatccgcgtatagcaaatggagcagtttcgccttttccaagctattcagatattcgatgacagtattacgatgaatacctatagttgttgacaatttggaaatatccacctcaaaaggaacagaagttgcaagaatgcccaacaaggcctttatcttacgcacattacccacatcaattccacacaactggggcaattccgtttctacaataaaattaacaacctgttctatacttgtataataatctatctgatttttcaaataaaacggataatatccatattgcagatattctttaaaaagaggtaaagggcgacacactttattcacttccgaacaaatcttttcgggcgaggtcaagacttcttccagcgtacatacgggaaagctcatttgtttataaaacaatagaaattctcggaaagagagcccctgcatctcataagggatacagcgtctggataagtcggcatcagcatttaatatattgagtaaagaggacgcgctgaacacaaccttcaaatcgggatacatgtcatatacttcttttatctccttactccaagtcggatatttatgtacctcatccagaaagagatgctttcctccattctttacgaatacatccgccaattccagcaaagtatgattagagaaataaacagaatccagtgtgcaatagagcacttccctactataaacctcataatgcagtttcatatactgtaacattaaagtcgtttttcccactcctcgaggccctctaatagccaccaactgagcatcccaattgattcgatgcatcaatgtccttataatttcagtcgatgtcaataacaacaaacggtcttgttttgcaaaaagagtttccatatattcctatatcttagtattatgagatacaaagataatcatttgctgtttgcaaacagcattttctctcactttttgctgtttgcaaacagcaaatgaacacgctttcaacaaaaggtgtctcaagcctatatctaccatataatgttccacctgatacaatacttacggagaattcctgaaaccttttattccacaatggaatggagacgtaagagttttaccgtcaacgatgcactctcaaatcttcaaagggtcaagaaaggaaacatttcttatcagaattggaataacatatgcaaaaaagaaatagtagcgattatttaacattgaacatttatataagcagaaaagaattgccagtaagggatcaagtgattatataaaaagaatgattgcatacaaaatggcagaaagcgacctcaatagacatctggtgtattgtcagaaagcacataagacaaattcgtaatattcagatacaccttgtccactttgcctaaaagtctgacaccttccgtctctgcccgaagctgattaattattccagccttttccagataacacatcaaatcggaaactgtatttctattcatatcaagcaaagtcgccaacttggtaaaattaggtttaacggaacacttttcgctatgatatacaacagtcttttcaatttcaatgctgtcgctatattcatattcgcaaaagtcggtatatcattttccaaagtctgcttaatgatactttgtaaacgaagcaaatatcccttttcctgaaagaaagggtaatagccatgttgcagatactccttaaacaacaaaataggacgcgcctcgacataaggaaaatctactttatgtttcagtatatcctctaaagaataaactggtaaatgataaccatacgaaatggcaaggtattcgcagaaagacaaccccaccatacgatattccaactttctacgactcaaatcagcctctccgacttccaaatccaatatagaggaaccagtatacacgacttacagtttgggaatcagatcgtatatattctttatctcccgagcccaaccagcatacttatgtatttcgtcaatatagagtttttttcctccatgctgatagaagtccatcgccagatcaatcagtttatgttctgcaaaatacaaatcatcagctgtcacaaacaaggtctcgtcgatattatcatatagcttgatatgttgcaaaagcatagttgttttaccaacaccgcgtggacctaaaatagcaataagcctactactccactctatctcatcatggagataacggataaattcagtggatatgttgctaagcaacattcggtatgacctataaagcgtatccatcatttcttgttttggggttatacagaaaaatatagagtaaattgccgaatgaaagctacagtttttctagaaaatgctagttttattcggcaatttactctatatctatcataatcctcacagaaaaagaatactcattctttaatatatagcggataatttcatagtcaaaatgcatatacgaataacctttaagccaaagatagtatcaaaaaacatttaactaagaaacataattatgataaccaacaaataacagattccacttattttaaagaccccatcttatatccaagatctgtttgatataatatattcttttattgaataatagacgcacatcaaaattatagtgccaatcatatccttgctcccatataaaccacataatttataagaaaacatcagaggcatcaaaaaataagaacagaaatagccaactacttacactacaatatctagcaatatagtcctaaataataaacattatggaatcttctgaatgataccttcccagctatcaataccaatccgctgcaagtattgttcaaagtactcattttctgcatcagtaccagctttttgataagtcatccataccggtttagcttccccctgatattccgcatcattgtatttacgtaatcctaaacgagcaccatcacccagatgatcgaaccaactatgccattggattccattaatcccttccaaagcattgatcttcttccacccaaaagcaaacccagcagcttgattctgcaaatccttatccgcataacttggagaacatgttccagcctcagaaagccacacagaacgcctgatgcctcccttatattggttttgtgggacactaacccatttatccaatacttcaaggttcttcaatgtcacatattctgtatccatagaaaaagtagcctgagcatcatcccaagtacaaggattccccaattgagccgggtaactatggcatgccaatgaccaaaagaagtctccctctgctttacaaaacagattcataaagtcaagcatatctctgaccttataccaaccgcccccagcagcaatattccatccatgagagaaagaaataaaaacctctgaattctggtcatattgatgtacaatattataacacatacgcattgaacgaagatacgtatccataaatgtagcaattggtttatctcccatatttgtccaatggctacctccatccacctcattatgaataatccaatgcgcaatacgcataccaggtttactatatctttgtgccagaaaatcaagcgcagcagcataacattgcgtagactctatagtagtcatattaggcatggtataaggagctatgccattaaaatccggatgtttcagaagttctccggcatctccttcaggagaaaccaacaaaataccagcaacagaaatattgcgctggctagtttgttctaataccacatcaaatgcacttctaagatactcctcattaaaataataagttactcccccatacacatacggaatatctcccgactgttgagaaagatgcataaaatttgtaataggaatatttattgtagcactgctgattcctaattcatctaaatctgatgcaagaaactcatgatttataagtccccccaatccttttttagactttaatggaatagctccaacattttgttttacataaattccatctgcccccacataacgagcatgagatacttgttcatctttttctactccttccttaaatattgcccacttagataataaacgatcatactgataaccaccaatagccgcataacgattcaaatggatttcaaaagaattctgtgacaaaactgttttatatatagattctatcttttttgctttaaacatatcaacaaaaggcggtatttctcctaaaaagaaaattccatccccctgatagtttccccggacactaattatgtccttcccgacggtgatatcagtcacatggcaattataacccttatttagatagtcttttatattttgctcatatttttccttattgagaatttcattatcttcttcctcctcttccttcctttcctcctcattcattacacgcagacatatattacgtatttgtatcgtattatcaggaacattaccaaaatctatccgcaaataatcgccctttttcccccaatcaaaatctttacgatattgttttaaacgcacgctaaaagatttccatgtttcagtacccggaacttcccctgcactcatgctatgagaagcatcaatattggtttcagcatctgcaaaaaaaagttccagattgcttatacccatcattgtctggtattcaaactcaagcacattacattcctttggaatgtcttccttaaatcggccacccgtaacccacggatctccatcaatagtttctataatataactatcatcctcatttcgagttaaaactacccctgatttatatggaccatctaatagcatataaacaggaggagttatgatctcttcaggaggtatagaacctcctccagtgtcttccacaaaatcatcaccacaagaaatcacattcacaattaaaaacggtattaacaacggcataacacaacgccttacaacatattccagctttttggtacaaacaatacttaacattttcataatttcagttttagttaataatgcagataaattaaaatttttcaataatattccaatcagaaattccaattacagatagaaactgttcaaaatattcatcttcttcttctgtgtttgctttttgatagacataccaaaccggctttgcttctccattataagttgcatccagatacttacgcaaccccaagcaagccccatcacctggatgatcgaaccaattgtgccattgtattccgtctatgccttctaatgcgtttatctttttccatgcgtaagcaaaacctgccgcctgtttctgaaaatcctcatctgaatatgtaggagaatttacacctgcctctgaaagccatacagaacgcttaacagtccctttatacttattttctttagacaaagcccatttattcaacacctctaaattcttgaatgttatatactttgtatccatagagtaagttgcatccgggtcaagccatgtacaaggattaaataatgattgcgcataactatgatatgccatagcccattggaaatctccctcaacccgactataagtgttcaacaaatcaacaatgtctttactagtataccatcccacattagaaatatcagtccacgaatgtgaaaaagaagcgaacacctctgcatgttcatcatactgacgcacaatattataacacatacgcatagactttatataagtatccgaaaagatagtaacaggcttcactcccatatttgtccatgagagcccaccatcaacctcattatgcataatccaatgagagatacgtccatagcgattatctgatctacaataccttctagctaaaaaatcaagtgccgcagcatagcaatttaccgactccaaagttgtcatattaggcatcgtataagttccttcactataatccggatgctgtaataattctccaattcccgtatctacacttcgtgaagccggatcaattaaaataattgccgcaacggagatattccttttttttgttgcttctaataaaactttgtctaaagtattattgagatactcttcatccatataatacgtttttcctccatacagatgttctatatctcctgctttgggagtaagatgcataaaatgagtaatacaaacattaattgtagcactactaatacccaataaacttaaatctgatataaacgaatttgcagtaagacctcccagtcctttcttagaagtcaatgtaataggagataaatgttgatatgcccaaatttcatctgcatgtcgtgcatgagacaccaattggtctgctagatctgtcatttgaaaaatagcccattttgacaataaccgatcatataaaacaccttctctttcaataaaacgatctaatacgatactaaacgatgcttcagtcaactctaccttatatggggccttgtctatctttgtaacatccaaataaggagggatctcacccaaataaaaatgcccttcacccacacagttacccacaatttcaatagaggattctgttacagatactttatttataacagagggataagtatttcgcaaatattgtttcaggctatcttcatatttcagatcatcttcattataaattgaagatataacttcttcctcttgatcttcatgacatccaactaacaacattagtccagataacaaaaacaatacaaaaagcaacaatcgcttcagtctatcactgcttacgagtgatcgattttcaaatatgcccataagtaaataaaaataacaggtttaggattctttcgtacaaagatagactatacgattgaaaaaaagattttgtttctcttttttttgtttatcttttttgttttaaacatatatagatatcacaaaaattatccaaactttattcatttttctaatcactgaacatatattattacgcataaatcactatttttgcaaaaaaaaatgcaggaataattatcatagaaaaaatccttagagactcctataagcacaaaaacagaatttccacatgattatagcacactaatatacaatcaaccaacaacaatcatcataaaccaaaacaatagaaatgaacctaaacaatacgccacaactatccataatcacaattaacagaaatgacgctcagggcttagagaaaactctagaaagtatatggaaaaaacaatcctttaaggattttgaacatattattattgatggagcctcaaccgataatagtattaacattataaaaaagtatgcatcacatttatcttattgggtatcagaacctgataaaggaatctataatgctatgaacaaaggaattattaaagctaaaggcaactatcttttgtttttaaattccggtgattggttagaaaatgacattctagcacgagtatttaaggaaaatttcacagaagatattgtctatgctgatttatatcaatatcgtaatgctgatgatatacaaatcagcccttatcccgacaaattgaccctaccttttatatataattattctttaggacatccgtcgacttttattaaaagagaactctttaaaaatatgctatatgaagaaaaataccgaattatatcagattgggctttttttataacacagatccttttgtttaatcgcacaacaaaacatctaaattttgcagtctcatactttaatgtttatggaataagttctgaccctaaaagtggtaacttaatcatgcaagaacgttccgatttttttaaaaataattttccctatttgattagcgagttttatcagaatcatactacccttcaagagaaggtaagaactcaagagcaggcattagacatattatcaaagcaccgagttcaacaactcatagacactgtttggatccaaagaaaagcacgacagtatattaaattcttatttttaatagaaagatttcttaaaagaaaaagataataaacacctcaagtcgtcactctgaatatctaaaagaatctaatgccgacctctatccaaacatcatacaataataacattgaatatacaatattagaaatgacgaatattaatcaaaaaaaaatagtagctttgcaatctataaaccagaaaaaactaatgtataacatcattgttaacagaaataaaaaatgagaagaaagttgattcgaaaatataaagcattcaatcaagactttcaaaggtctaaagagctatttcttaaatggtttattcccgaaatcaaaaaaaggttctttggagtaaagaaaatcaactataaagacatccctatcattattaacaactacaaccgtttggaaatgctaacaaagctaatccatagcttagaaagtaaaggataccataatttatatattattgataaccaatcaacataccctccactattagaatactatacaagattaccataccctgtatatatgttaaataagaatgtcgggcatctatcattgtgggaaacagggatatttaagcaattcaaggattcttattatgcctataccgattctgatttagagatcctccctaattgtcctgacgattttattgagaaatttattttattactacagaaatatccaaaagcattgaaggctggcttctcaatctgcatagacgacctaccagatcattataaattaaaagaaaaagttatagagtgggaaagcgttttctggaaagaagaaatagagcctaacatattcaaagctttaatagatacaacctttgctgtatataagccctattttatcggggaacctattgatccagactgtttctgtattcgaaccggctacccttattccgtcaggcatttaccttggtatatgaatagcgcaaaaccaactgaagaagaattatattatttggggcatattaaaacgctaacccattggtcaaaacaaaatcagacaaatacaaactcggctaaaaaagagtgaaaaatatatctataatgttctctattaaataacgcaataaaaatatcagattatgaaatgttacatttgtctgacagactccatagtcactcgaaaagactatcttgatttactaaaagtcatgttaatcagtgctaggaaaaacacatctctccatttagtttgcctatatgatggcaacaccaatgaccctgtttataacttattaaaggaattcaatgtagaaataatcctccatcaattgccctataagctagagttgatggagatatatccgcgtgaatggatgttgcagaatttagggaaagaaatcgaatataaccgaattttcggaacatttatgagaatggaaatccctgttgtggaaaaagaagaaaagtatgttctttattctgatatagacgtgattttcaatgctgacattttacttgaggaacttccacatcccacttatctagcagctgccccagaatatgagcgtaatgtggaagatatggaatattttaatgcaggagtattagttatgaacatccaaggcatgaaagagaaatatgaggaatttattcttaaaatgaaaaatagagaaagaaacatatccggactttttgaccaaggatatttaaacgaattatgcttcaaagacatggaactactaccaatagaatataattggaaaccttattggggtatcaatgacaaagctaaacttatccatttccatggtatgaagcctagtagcaatctcaatgaggctggttttattactgataattcttttttccgtatcgtttttgatgcaaatcctggcggctatgcaggatatgtatattattttactcaattctatgattatctgggaagaaaagacgacaaatggttatacaatcacctacaagaagttttcaatttatataaagatccatcttttttcttttctaaatataacaagtataagcttaaataccagaaatataagaaatactatttagttactttaggaatatcctgtgtcttactgatactgttatgtttaacccttattctacaataatgaagaaacaaccattgatatcagttatcgttgcttcgtacaactatgctaaatatataaaagagactttagattctttaatcagacaaaccaataaatcatttgaagttattgttgtagatgatggaagcaaagatcaaagccttcctataatagaagaatatgccaaccgttttaaaaacataaaactatacacacatcccggtaaccagaacaggggattagctgagactgtaatattaggaattgaaaagtctaatggagagtacatcgcattctgtgagagtgatgattattggaccaataaccatattgaatatttacaagatacaattcaacagaatcctttagcaaatttcatagtcaatggtatcaaagttataaacctatcaaataaccctgaatatgattcatatatagaatttagttcctcattcctcaaaaaacattcaggcagtaacatatttccctaccttgattcaaactatatccccacattctccgccgtttgtgtaaaaaaagaagtaattcaaaatattaattttagcaccccttaccccgcatggttggatttctggctttggagacaaatatgtgtgttcaataaagtctattacattccccaggaattaactttatggagaaaacacaatgaaagttatgatgcagtctcggataataaagatttcaacggctttataaaaagctcagaccaatatctagtatctcaatacagtttatcccagataatagccaatgccaatattcccaaagataaaaagtctctcaaacaatttattagatctttttgccacttcatatcattcaagaatgaatagcagcagttaatgtgtaaagaatctaaaacgttttcaagatgacaatatagaatcaaaggctcaacaaaaacattaaaattcatctttaagaatagaagtataaaccgataatctccgatccaacatttcttgtggattatacatattcttcattttgtcattagcttgatgaaccaatattttttgtaactccaaatcattggataatttaatcatagcatctgcgaaatcaacagtattatcggctatcaagcaatctacgccgtcgctaaaatgaataccttccaatccttttgaagttgtaataaaaggaacatttgaagaaaccatatcaagtattttcattctcataccacttccgatacgaataggaacaagagcaatgctcccctgcaagaaagaggtcaaattctcaacgaatccaactaactctatctcaggacaagccgttcgtaattcagcagaatagcgttcatatcccattccaaccacttgcaaagtgaactcaaaattgcatttacgtaaataaggaacaatttccttacaaagccatacaacagcatctagatttggaaaatgttctccatatcccacaaaagtaaaacgtcgatgaacacaagggataaactccgtctctgaattcgattcaaattttaccactgcaggagaagcataaatatgatcttcgcgacctaaatagctagctaacaatagtctatcgacttccgttaaagcaattatatgcttatacttctgcaacgcattccattcgaagtcttttgcaacaagaaaattcatccggtcactaggccgtattgcctgaaaaaggttcatctcattctcgttacgtatatatcgcaattcatgatgaacgaaaatcgtctgtacattctgcggtaacacatatcccaatgctatcaattcataaaactctacctgaatgatatcaaaccctgtatgtgctacttttgtaacataatctatatatcgtgtatcaaattctttatatacagaattaggtaaaacagacttttcacgtacaaaatctttatctttcaacaaatcaacggtactgtttgacgtagataataactgcctccgcattttacgctcaatagacatcttgagttttttcagccacttataataaaaaggatttcgcactaaaggagagtccggttcttcttttgtctccttaacaaaagtataaaaatccacatcttcccacaaatcttctaacttttctaccctttttgcctcatcaatcgtccaagcataaaacaacacagaaactgacattttatgacggatatagtctaccatttgaaagaaagcctgatttcccccagaattcaaagggtaaggaacacaaggtataataaaaagtattttcttcattttgcatttcaataaaattaatattcaaccatctctttctaactaggagataaattcatttcattcaaataaaaagtttggctttcaaaatatgggaacgtaggatacgtgaagccacagtaggagagaattttctcaaaatagcatataaacaaaccaaatcttttagactataatttcctcttacagaacactctagtattacattcacataagtcaccaacgcatcttgaaatctagactcccggagatttaatctataattcattccaatccattttagaaaaagtccggtagctttaagcttctccccatcaaaacgtgtagaattacttatattcttatcttcagcattccgccaataaacaggagttcccggtaatgaaataataccagatgcataatccgcaaactttgcccatgttgcatcatctgaacaccatgccaaaggaaacctaacaaaccctcctgttttcttccaaacatcacgtgtaaatacatactcacacgcagcagaggatattttaccacttaacttgtctaataagaaatcataaccagaaatcctttctgtctcaaaaggtggattagtatatttcagttcaccatacgcatctactatagccaaaggaaagcgaaatacagcatcgcattctccagacttcttccaaccctttattacccgctctacagcatctggtggcattaaatcatcatctgaaaaaagccataccagcggctcatcagataattcaatacagcgttcccaatgggcaaccaaatctctcccaccccaattttgttcaaaacggaaatagaatatatctaatttatccttataatcagatactattgattctaaatcatcaggactggcatcatcaccgatatagaccgtaaaatcacggttactctgccttacaatagaatctaaaacctcccgaaaaaaacaagctttataagcaggtataatgatcgccagtttatttttcatttttctaactattcaatagtttcatttgcaaagataagtaaatgagatgaaagatttgcattaataagatcactttaatttctgatattctcgattctaatagagacaaacctaacaatcaattatacaagaacaattgactttatattttggaagctccctatacccaaataacatcaaaagccatagcagagtattaagttagacgaaaaacatattgccttaaaatctatacctctgagattaataacttgccactcttattttttctttatacctttgtgtcattatgtataaaaacaatctgtacttctacaaagtggtacttcacctcaatctattttaattcaccatggatactgatattataataccaatctataatgcttttgattttaccaagaagtgtatagagactgtgattgagcatacagaccttactaaacataccttactacttatcaatgataaaagtacagaccagcgaatccttcctttgctaaacctgtttacaacagaatatccatctttaaatattacaataatcaacaatgagagcaatcaaggatttgtacgaacggttaatatcgggatgcaacactcgtcacgcgatgttgttttattaaatagcgacacagaggtcacgaaaaattggctccctaaaatacaaaagtgcgcatatagcaaagctgcaatagcaactgttactccactatctaacaatgcgacattagcatccgtacctgattttatgtcagaaaatacgataccatcagattttacgatagaggaatatgcaggaattgttgaaagatgcagcatgaacctattccctgaaattcctactgcaaatggattttgtatgtatattaaacgagaagccataaacaacattggtctcttcgacgaaaaaacttttggaaaaggctacggtgaagaaaatgatttttcgtacagatgtctacaagctggatatagacatctactatgtgacaacacatacatctatcataaaggaacccagtcattttctcaagaaaaaacagagctaataaattctcacctacaaatattaaaaagtagatatccttcatgcgttgagaacacagagtcctttgtacaacaaaatccaatttcagatatacagttaaatatccgctatgccattaattcacattctaagaaaaatgtattaatcgtaatacatgatttcaaagaagccgaaaagaaaaatataggaggaacaactttacatgtacatgatttaataacaaatatgaaagaagaatttaattttcatgttctttattattccgatgatgattttaaatatcatgtaacttcttttttaccatttgacaaaattacctccaccctaggtgcatattcacaatatacgacattaaacctctataatgacacatttaatagagacattaaaatactaatagacactttaaaaatagacttaatacatatccatcatttaaaacacatgtatttggacatattcaaagtagcaaaagaaagaagtatccctgtcatatatactttacatgacttttattcaatatgtccttctgtgaagctctttaacaaagaaacttttctatgcaactatgctaacgcagcaggatgtggttcatgcatagcaaaaacattcaacctgaatatcaacttcattccactttggagaaaagagttttatgaaaatcttaaaaccgtaaaaaagatcattgttccatcgtacagtacaaaaaacatattcctgaacacatataaggatttaacaatcgaagtagtagaacatggttatgacaaaataaacggaaatccaaataatgacaatccagataaaaagaagaataaaaagtttaatatcgcctttattggatatataacagaagaaaaaggactaaaatatttagaggaattaacagagaaagtaaaaggcacagacataaacgtccatcttttcggacaaacaacaaacaaaaaatgcaataagaataagaaaaattatgtttatcacggcaagtatatacaacaagatcttcccaacttactgctagagaatgacataaaattaatctgcttattatctatgtggcccgaaacatattcttataccttatcagaaagtttaatttcagagatccccgtaatctcatttgatctaggagcaattgccgaacgagtaaaaaaagcagatgtcggctggattttacctataaatagtacattagacgatatctttaaactcatttcaactataaaatcagccccacaagagtataaacagaaagtggaaagaatcagacatcttttaaaaaacatgaagtccttaaaagatatgggcaatgaatacacagaaatatacaataaaacgatcaacgtatttcctgttaaaaatcatgacatatactatatacaatcaaggaatgaattttatagaaaaggaaaagagaccccgacattagaccttaaagaagaaaaaaaagagtataaacgagtaaagcatattattaaaagttcagttcctctcaaacaagcttttaatgaagtgcaaaattttcgccacacctataccaatagtaaatgcagaaacaaaatctttttcaaatttatatggtacagaattctacgaattaatatctagagaaatctttttgtaagatttctctagctctggctcgaacacgagcaacattatatattctagaaaaaaacaatcacctccctatatctaaaagccatcttcttgcatactttttaccaccttttctgtttcttctaaataacggaatccccattttaaatcaggttccaaatgattaccttctgcccattcattccaagcattgacaaaaacaaaattctcatctttgctataaggcacaaatttattcataaccgaatataaccattcaccgtatttttcgggagtactcttgtctaaaataaacatcttttgctttcgacgagaagtattatcccacattggagtaacccccggatacattttatagtcaggaaaatgagttttacagatataatctacatattccgagtaatcaatctttttcttcttacatgtattaaaaaggtgacgatttatattataagcaaacttccgtaatggatttctttttttttgaaactcattcatttgatgagtgaaaggttgaaactctacggcagcatcaaaaccatcctgaaggtattcttctccataacaatccatagtttcgacgcggcataaatacaactccactcctttactagaagcttcttccctccaaactcgaatagtctctttcatattcggaaaaagcatagaacgataaattaaaaacacaggtttaccgtctactcttatatatcgagaatcactaaatacattatctaacagataacggatatgcgcacgatcatcctcttccgagtaattttgagcaatcaaaatatgacgacttccaccatcccacgcccttgtccaattttcattagcccaacaaagcataaatggaaaatcaggattgccagaagacagcatttcttctaatggtctttccatcaattgatgaccattaaaccaataatgataataacaaaagccattaattccgtacattcgagccatatcagcttgctgctgacgaacttccggaacacgcagatcataaaaacctaaatctgccggtaaatgtggctgataatggccacgataaagaggtctagccttgaccacatttctccattcagtaaatcccttaccccaccattcatcattttcaggaaatggatgatattgcggcaaataaaatgctataattcttttgtcaaccatatctttctttattgcacttcacaattcattacaacctatctctatctcttgtaggttgccatggattcaaaaaactcatgtatttattaactcgttcccatctatatgtccacacacttgtgccaaaacatcctttcagtttttcaaacaacaacaatctcattttcggatcaacttttgcacgctttatatttttataaagcattccatgtcgcatcaaacgcttataacgccctattggataagaaaatgattcaacataatgtactacttgaatatcttcaagaatcgcattacctgaagcgttaccctcaacagttgtacttgttgaatgcaatcgaaaaaagtttagcttttcatataactcaataacactcccttgcctcgccatctctatccaaaaaagccaatcaccactatagcgcattgagaaacaagacaaatcctttatctgttcaaaacattgtttacgaaagacaacaccactagcattgtaaatataattgcgccaataaagattctgttttatataatcttcactatcaaaaacacctatattgtaaggacggcgtaattgctttgaagtccaacggtcaaaatctgtagatagtttattccctttctcgtctatacaatgtgaacctaaaaaacagaaagaagcatgaggatattgatttaagatagaaacagctttttccaaaaaagaagaatcagccacatcatcactctcggcaatccatatatattttccacgagacaaacttattcctttttgccactgtataaaaggactccctgtattgactgaattaatctccaaatgagcgacacgagaatttgttttataatggtttaaaatagacacactatcatcggttgaagcatcatccaataatattatttcatagtctgtatatgtttgtgccaatactgactcgatacgttgctgtaaaaaacgagcatagttataattagggatgattatactaacttctatcggataattttccattacaaacacactatttatcttagttattataacaaactgatagcaaagatacggatattattcttaaaaaagaatgctaaccctctaatgtttagcaaaaaagcctttaacgcttgtcacaaccaaataaaatgtatacatttgtagaattttagtgcaagcccccttaactatttaactaacttagtaataattatatgaataaacccatggcgagcaacataagtacatcgctaattatatccacctataatagaagcgacgcattagaattatgcgttaaaagcgtgctacgtcaatctctccttccagatgaaattatcattgccgatgatggttctaaagaagatacaagagaactaattcatcaattagcagcctcctccgaagtccctattattcatgtttggcatgaggatctaggcttcagactggcctccatccgcaacaaagctattgcgaaagcatctaaagaatatattatacaaattgacggagatatcgtcttacacaaagatttcgtcaaagatcatgtacattttgctaaaaaaggcagtttcgtaaccggtagccgtgtattaatccgggaaggtttaaccaaaaagatgctagcagaaaggaactgtattatctctattcacgacaaaggtactaaaaacacaatcaacggagtacatttgccttggctaagcccactacttcagcattatcgccaatgggatatttcatattccagaggatgcaatatggctttctggaaagaggatttattaaaagtcaatgggtacaatgaagctattaccggatggggaagcgaagatcatgaattagtgtgccgcctcatcaatagcggtgtacgcaagcgtaccatcaaatttgcgggaattgtgttccaccttcatcacgaattacatggaacggataatttgagcaacaaccgcagtattttgaacgaaacgaaagtcaggaaactaacctggtgcgataaaggaatcatacaaaactaatatggaaaagaatttgaactttttagatcgaaacgaatttaactacagtccatcaaaagaagtagtagaagctttaaaaaacttcgatataaataaactttgtttttatacccgcatttatgatgaaggaaagaaaagtatattatctgttttcttatccgaactttacgatatagatgaaacacaagtcttattaggatacggcggagaagatattctgaaacaagctgtacactacttcctgactcaagaagatggaaataaaacgatgttgattcccaagttctcatggtggtattataaatcaattgcagatgaggtgaatggccatactttgcaatatcctctctacgaagacggaaatacttttaaatatgactttgagacgctaaaagatatgattcagaaagagaatccgaagattcttttactagcttctcccaataaccctaccggcaatggtttaactccaaaagaattggatgaactgctcgcagaagtgcccagccaaacagtggtactgatagacgaagcatacgcttcttttgtttcaactgataccagttacatcaaaaagctggttaataaatatccgaatttgattatttcccgtactttatccaagttttatggattgcccggtttacgtatgggattcggatttatgagtaaggaactggaaaaattcagtagatacagcaataaatatctgggatacaaccggatatccgaagatatcgccattgcggctcttaaatcggacgcacactaccgaaacatcgccaaactaatgaatgaagaccgtgagcgttacgaaaaggaaatcggtgtattacccggattcaaagtatatgaatcggttgccaactttattttaatcaaatacccgatagaactgaaagaggctttacaaaaggcttttgctgaacagagttataaagtgaaatttatgaatgaaccggatatcaatactcatttgcgtatcacattgggacgcccagagcagaaccggatcgttatagatacaatcaaagaaatagcatccaaatgaaagcagtaatattagccgcaggaatagcttcacgcttacgcccgctgaccgatacgacgcccaaatgtcttctcaaaataggagaacgatgccttttggaaagggcttttgatgccctgatacaaaacggatttgatgaattcatcattgtcaccgggtatcgccagcagcaaatcgtagattttctacaggcacattatccaacccaagatattactttcatctataatgacaggtatgaatcaaccaacaatatctattcattatggctcacccgtccatatacggatggggaagaaattttgttattagacagcgacattgtatttgatccgcagattgtagagaaactgcttcattcggataaggacgacatattggcactgaatcgtcatgagctcggagcagaagaaataaaagtcatcgtggacgacgcacaaaaggtcgttgaaatcagcaaagtctgctcgatatccgatgctatcggagaatctatcggcattgaaaagatgtcagctgaatataccaaagcgctattccgggaactggaaattatgattactaccgaaggactggataatatattctacgaacgggcttttgagagactgattccgcaaggatatagtttttacgttatggacaccaccgagttcttctcggccgagctggacacagtagaagactttcaacaggcacagaagctgattccagccagtctttattaattaaaatcagatagaatggctaattacgacatccgccctctacagcttcgcatattaaagaacttattagctgttgacaaagtttgcaaagaacataatctgcgatattacatcatggcaggcaccatgttgggagctgtgcgccacaaaggattcatcccctgggatgatgacttggatatcggaatgccaagagctgattatgacttactaatggctaatgccaaagaatggttaccgaaaccttacgaagcggtatgcgctgagaatgataaggaatatcctcttccgttcgcaaaggtgcaggatgccaacacaactttaatcgagcgtatgcatctcaaatacctgggaggtgtatatattgatatatttccactagatggagttccggaaagccgtatggcgcaaagaatgcattttgcgaagtatgagttttacaaacgagtactttatcttattcatcgcgatccatacaaacatggaaaaggtcccagttcatggataccgctattatgcagaaagttttttacccttaccggagcacaggaaagcatcaggaaggtgatgaagaaatacgatttcgaccaatgcgcattagtctgcgattatgatgatggaatgaaaggaatcatgtcgaaggatatcctgggcactcccactcctatccggtttgaagatgaagaagtatggggagtacagaaatacgacgcttatctgtcacagaaatatggagattatatgaccatacctaaacaaagtggacaaagacaacataatttccattatttagacttgaataaaccttatcggaattttgaagtctaattataatcacataaaggtaagaagaagaaatgagaataggttttgacggaaaacgtgcagtacagaatttcaccggtctgggtaattatagccgctatatagtggatatcctatgccaattctatccggagaatgaatatgtgctgtatgcccccaagaaacgggaaaacaagaggctggacaaattaacgaagcagtatcagcaactacagctttcttatcccactacttcttcctggaaaaagttaagttcattgtggcgagtatggggcgttacccaacaactggaaaaagaaaaaatcgatatattccacggacttagtaatgagttgcccctgaatatacatcaaagcgaggtaaaaagtattgtaacgattcacgatctgatctttctgcgctatccgcagtattaccattcgatcgacaggaaaatatacacatacaaattccgtaaagcttgcgaaaatgccgataaaatcattgctatcagcgaatgtaccaagcgtgatattattgagtatttcaggattcccgccgataagatagaagttgtttatcagggatgtgatccttcattcatgcatcctgtagcagcagagaagaaaagagaaatccgggctaaatatcagctaccggatcactatatccttaacgtaggaagtattgaagaacgcaaaaacgccctttcagcggtgcaggcactaacgatgcttcctgaacagattcatctcgtcattgtaggacgccacacggaatatactgataagattgaacgtttcattaaggagaataagctggaagaaagggtacatatcatcagcaatgttccttttgatgatctaccggctttttatcagttagcagaaatttttgtatacccttcccgtttcgaaggttttggtattcccattatagaagctctatactccggtattccggtagtggccgctacaggatcttgcctggaagaagccggaggtcccgactctatctatgtacatcctgacgatatcaatggaatggccaatgctttcaaacagatatactccgatactgaaagaaaaaaggagatgattgaaaaggggcaaaaatttgccaaaagattctctgaagaaaagcaagcggaagaaatcttaaacatctacaagaaactaatgaaatgaacgtacttaaacatacaataaagaaatttatatatggcactctcccatattatttcatgaaaggatataagcctggctctccttatctgaaatactatgaatatattaaagaacatggatattcaagacacctgtatgaattcaaggatgaatacgccaatatgcctgttgatgtacagaaagatgaggaaaaaggcttatactatgttcaaaaagaaaagaagcgactctatttcagaaaaagcactccagccaagaaaattcaaaaatattatagggctttgagtatggaacaagacaggcgctcaccgcaccattacttcaacagcgttaaagaagtgacagggaaagtatttgtggatgtcggttgtgccgaaggctattcatcattggaaattatcgaagaagccaaacatgtttatttgtttgagcaggacgagcaatggttggaagccatcagagctaccttcgaaccatggcaggataaagtgacgattgtccaaaagtatgtaagtgaccataattcttcgagagagcaaacattagacgatttcttcaataatcagacggatgaacatctgtttcttaaaatggatatagaaggagccgaacggcatgcattggcgggatgcaagaacttatttcagaattgccagaaactagattttgccatttgcacatatcacctgcgtgatgacgaagaagttatctctgcatttttgaacaagcataactgtacatatattaatcaaaaaggttttttcaggcatagaatccgcagtgtagtgatgcgcggaagtaagaagtaatcaatcattgataatcagcagaaagcaattcacaataatcatacttgcacagatatgtatcatagatatgcttttcctttttcaataagaaacgtgagatatgcggttcccaagaaaagaacttacgcacggaacggtataaacggaagaataaaatcagggacacaatatgcttttctttttctttccgtgccgcacgacgataaatgtaatgagtaaagaactgatcgctgtaacgaagggccagactgaccgtagattcgacgtcccatccacgcaaagaagcatattctgtcatgatgtaagtcagtacctcacgcgaaatacacaaacggcacatattacggcataccgtatcacaatcaatatccgatagcaactgcatacgattcacgtcgaccagagagaaactgtattcattcgtttcattctgatgaatcagtatattaccgggagaatagtccaaatgaaggatacctgcctgatgcaaagcagcagtgtagcgcgcaaaagctgaaagtttatcttcattcccctccacttttccatccatcagggaacggacagtttcgccgccatcataacaacaaatgtaatagctatgtgagagaagaccatcttgaaattgttcgatcatagccactggctccggagtgtcaaagccatgctgttgaatctccatagaataaatataggaacgttctgccttcgactggcggaaaaacgaatatacaacacgattgatgatgtgaggctttttaaagctcttcaccacaacatcaatgctgcccaaactaatccgttttagaacattacgaccatcgtacaccacatctccttcgttctggaaggacctcggaacttcttctatctccttctgcaaatgtgcgtacttgggatttacaatcactctcattacactctcctatataatcctaattacaaagattgagcaaagataaagaaattaggccatattccgactatatttttctcttttctcacaaagattggctaactctctccacatataagcaccgtcacggtgactttaatcgttttttcttttttcttttcatttatatttagacataaatgcttttttttagttatgtttgcacggtaaaaagcataaagaagtttaagcatgaaaccaatcaaaagaattctgattattcgatttagacaaataggggactcaattctggctattgcattgtgcagtacgctgaaaaaaagttttcccgacgcagagatacacttcgtgcttaataaaaatattgctccactctatgaggggcatccggacatagacaaagtcattacatttgacaagaatgagaataagccgttcactgcatatataaaaaaagtatggcaggtaatgcaccaaaataaatacgatataatcatcgacatgcgctctaccatccggactctttttttctctcttttttcattaagaactcctttccggatagggcgcatcaaaggatatacacgttttctactgaactaccggacagatacttacagcaaggatctgacaactgatatggtacaacgtaacctgttgcttgcagcaccattagaaaagatcagacctattcaatacacaaaagaattcaagttatatctgactgaccgggagaaagaagatttccgatattatatggaaaaggaagggattgattttgcacaccctgtgttactaataggagtcacaaccaaactcatccataagaaatggaatacggagttcatgatagccacactgaaaagaattttggaggagcacaaggacatacaaatgatcttcaactacgcaccggggtacgaagaagaagacgccagaaatatctacaaggaattaggatgtccggaacgtatcaaaatcgatatacaagcttcttcattgcgacagctggcagcactttgcgccaactgttcattttacttcgggaacgaaggaggagccagacacatcgcccaagctcttggagttccttcatttgccatttattcaccaagtgcatcaaaatcaatgtggttacccgccaattccgtacttgccgaaggaatcagtcctgacgacattctttcgccggaacaacaagcgacattaacctatgaagagcgttttgcattaattactcccgaaaaggtatacggacaattgacttcaatactaaggcaattgagctaactcccgatacaaatcaaggtaggcttgtatatgcttctcgtaactgaatgaagcggcatattccttgattttttccaagcgctccttgtctttataaaaatcaggtagatgctcccggatactttgcaccatagattctgtatccaaatgctcccacatgatagcgtgtccattacaaacttccggtaaactagtgcgattagcggcaaatacagccttcccaaattgcatagcttccaccaccggcaatccaaagccttctccctcactaggaaacaggaatgcctcacagttccggtataaccagatcttctcgctttgagagataacatccgtcaaaaagacattagtgagctgattctcacgaatcagattgcgcacttcttcagcataagcaaaatgagcatctccacaaatatatagatcatattccgggaaatgacgcattacgtcaaccaagagatggaagttcttttttctacggatttgtccaattgtaaaaaagaaaggacgccctgtagcaaacgacggctttgttccttctaatgtatcgattctctccactccattgtagatgacccggatctccttccctttcaaatctacatgctgccgaatgacatctgccacataatgagagatcgtagtcacgaccgctgccttattgactttattctgcatccggcgaagatacattttcgccttccagggctttttctctgttaagaaattaaagtcgtgtatagtaaagataaactttgtaccaccggcaatacgcaacatcttgcgctgttgattcaccgcatgccatacatctaccttgggaagggtaaaaggaaaaaacttattgatacgacgtaccggaacagaggtcacattcggaccaaattcctgcatatatttctgccgcaataaatatacaaaatgaagatcatctaccggcatagacgaaaaggcggttgcatagttggccgcaatctgcccgaagccggctgtgagactaccataattcgtaagatctatcagtacctttttctttcgttgtatctctttcatcattatttgattctacgctctttcggctcaataaacagctaatttgaacttcagcaaggattaatctacaatcccttctattttcgcaatgacctgctccggctttatatccctcaaacaggcataatcacctcgccagcaaggcttctgcccatatacagaacagggacggcatgacaaatcgagttgcacggtattgaccggcaattgtttccagcccataaaaccggcataaggatgggtggctccccaaatagagacaaccggaatattgaccagggatgccaaatgcatattggcagaatccattgaaagcatcacgtccagatggctcatcagattcagttcggtacgcatattcagtttaccgatcattgaaacgacagaaggatatttagcaatccatgcatcaaatacgtcctgctcgcttttaccgcctccaaagaggaaaacctttactttgggattggcagcaaaatgtgctataacttgctcctgcagttctaacggataaatcttacctgcatgtttggcaaaaggagctataccaatccacttttgatcttctttaggccctgtgactggttctatttccgcaaagtttccttttccttcgccataaatagaagagaaatttaatagtaccggtaaacctagcttctcaagtacatcggcataacgacgaaaagaactcttctgattttccatcaccttatcatgacggcgaaccagcttctttttgcctgcccttcctttacaaatggaagctaccggtttattggcaagacggaatcgcaaacataaatacttagaacgaagtacatgatgaaaatcagcaatgtaatcaaaatgcattgctttcaattccgaataaaggctattcaagccccaaagccccttgtgcttgcctgttaaatcagctccgacaaaacccacattggcaggcaacccctgaaagagtggctgccatacagcacgacttaacactgttatttcatgctgcgggtattgcacagccagcgaatgtattaccgggattgtcatggctacatcgccaagagctgaaaaacgaataatgagaatacgcgccattcgttattttttcgcataaagcaccggatttaatgccgggtcattatacatcttcatctgtttatatactttcatatattttcttccggcttcgatatcagccaacagctgttcaatagctgtagaaaggtctttgcgttgttccagcaggatattcaacttagtctggcattgagcacggtgttcctcggtagtgtccgtacgttccacctcctgctgcatgtggtaaattttcaatgcaagaattgacaagcggtcaattgcccatgcagggctttccgtattgatcgttgcgtcagagagaggttttacctctttgtatttgtctaaaaagtagctatcaattaattccaccaggtctgtacggtcctgatttgatttatcaattcttcttttcaaggccaatgcttctaccggatcaatctgcgggtcacggataatatcctcaaaatgccattgcacagcatcaatccagttctttagatataaataatactcaatagttttcaactcgtaaggattgttcatcggagcatccacactatccgttacatggtaatctgttgtcgatttccaaaaaatctcgttgcaaaggttactaaatgtcataatcttaactagctaatagatatataatagggcaaatctatgtaatatttttcagacaagcaaccgtttcttacttttttatttgttacctttgtgggtataaaagatgaattgtatatgaaaattattatcgacaataaaataccttatataaaagaagcggtgcagagaatagccgatgaggtagtttatgcaccggggaaagatttcactccggagctcgtacgggatgcggacgcacttattgtccgtacccgcacacattgcaaccgggatttattggaaggtagtcgagtgaaattcatagcgacggcaaccataggtttcgaccatattgatacggagtattgcaaacaggccggtatcgaatggacgaatgcaccgggatgtaattcggcttctgtcgcccaatatatacagtcatcgcttcttgtatggaagtccgtcaggaataaaagactgaatgaactgacgattggaatcataggagtaggaaatgtcgggagtaaggtagctaaagttgcccaggattttggcatgcgtgttttattgaatgatttgccacgggaagaaaaagaaggtgcagaacgattctcttcactggagaaaatagcggaagagtgtgacatcatcacttttcacgtacctttatataaggaaggaaagtataaaacgttccacttggcggatgaagttttctttcagtcactcaaacggaagcctgttatcatcaatacctcacgaggagaagtcatccagactgatgctcttttaaaagccttgaacagccagatgatttcggatgccatcatcgacgtatgggagcatgaaccggaaatcaaccgtgatctattggaaaagacatttatcggaactcctcacattgcaggttactctgcagatggaaaagcaaacgccacacgtatgtcattggatgccatctgcaaatttttccaaataaaaggggattatgaaattaacgcacccgcacctgtctcccccattattcatgcaaaaaaccacgaagaagcagtcctccaaatgtataatccaaccgaagacagcaaccggctaaaaaatcaaccggagctattcgaaaccctacgcggagattatcctttgcggagagaagagaaagcatacattattaagtattaggtattaagtttcaagtaagtatcaaacattaatcgcattgaccgaaaaatttaataaaattctgtcaaaggattatctgtacgacgtaatacttaatacctgatacttaattcttattatttagtacttgttctatgatttgagggaagtgttcatattccaaagcatgcaccttcttagctacatcatccggagaatcagtcgaaagaacagggcaagtagcttgaaaaatcgtatttccttcgtcgtaatgctcatttatataatgtatagtaatgccgctttctttctcaccggcagccactaccgcttcatgtacccggtcaccatacattcctttgcctccgtacttcggcagaagagcaggatgtatatttataattttatcgggataagcatgcaaaagcaaatccggcacgcgaactaagaagccggccaacacgacaaaatcaatgcggtactcctgcaaaatagccaaaatttcatctccggctatccaatcctcctttggaaacacgttagaaggcactcccaagcgatgcgcacgttccaaaacataggcgtcacttttattagaaagcaccaacgaaacctgaacggaatcgtttttttggaaataccggataatattctcggcatttgaaccggaaccggaagcgaaaattgcgatgtttttcttcataactctcaaattcgatgcacaaaacagtgaaaaatgtgcaaaacattgcatttatttagtcaaatatttgcgcaaaacgataaatattcattcctttgcaccgcaaatttaaagaaataaaactaattattaattaaaaacttaaagttatgtctgaaattgcatcaagagtaaaagcgattatcgttgataaattaggcgtagaagaatcagaagttactaacgaagcaagcttcactaacgacctgggagcagattctcttgacactgtagaacttatcatggaattcgaaaaagaattcggtatctctattcctgatgaccaagcagaaaagattggtactgtaggtgatgctgtatcttatatcgaagaacacgctaagtaattcgatttcatcaatatggaattaaaaagagtggtagtaacaggccttggcgccattactcccgttggcaacagcgttcccgaattttgggaaaacattgtgaacggggttagtggagcagggcctattactcattttgatgcgtcgttattcaagacccaattcgcatgcgaagtgaaagacttcgatgcaacgaaatacatagaccgcaaagaagcaagaaagatggacctgtatactcaatatgccatcgctgttgctaaagaagcggtgagtgattccggtcttgacgtcgagaaagaagacttgaacaaaatcggtgttattttcggcgccggtattggtggtatacatacatttgaagaagaggtaggcaactactacactcgtcaggaaatgggtccgaagtttaatccgttcttcattccaaagatgatttcggatattgcagccggacagatttctatcatgtatggtttccatggtcctaactacgcgacttgttcagcatgtgctacttcaaccaacgctattgcagatgccttcaacctgattcgtttgggtaaagcaaatgtaattgtatccggtggttcggaagcagcaatcttcccggcaggtgtaggcggtttcaacgctatgcacgccttgtcaacacgcaacgacgaagcttctaaagcttcacgtccgtttagcgcaagccgcgatggtttcgttatgggcgaaggtggcggttgcttgatcctggaagaattggaacacgctaaagctcgtggtgcaaaaatctatgcagaagttgccggtgtaggtatgtctgcagatgcacatcacttgactgcttctcatccggaaggtctgggagcgaaactggtgatgatgaatgcactggaagatgcggaaatggatccgaaagaagtagattatatcaatgtacacggtacatctactccggttggtgatatttcagaagcaaaagcaatcaaggaagtattcggtaatcatgcgttcgagttgaacatcagttcaaccaaatcaatgacaggtcacttgctgggagctgccggtgcggtagaatctattgcaagcatccttgccattaagaacggcattgttcctccgactatcaaccacgaagaaggtgacgacgacgagaacatcgactataaccttaatttcacgttcaacaaagcacagaaacgcgaagttaatgttgccttgtccaatacattcggatttggcggtcacaatgcgtgcgttatcttcaagaaatacgcagagtaatatcgtgttacgtaacgaaatagataagataaggctcttgttccgcaaggatagagagtcttatctttgtttttaccggatactcgggttctacccgcgcaatatccagctttatgagcaggctctcctgcacaaatcgacttctgtccgctccgacaagggacgtcccctcaacaatgaacggctggagtttttaggtgacgccatcctcgacgccatcgtgggagatattgtctacaaacgtttcgaagggaaacgggaaggtttcctgaccaatacacgttccaagattgtacaacgggagacgttgaacaagttggccgttgaaatcggcctggataagctcatcaagtattctacccgctcttcttctcacaacagctacatgtacggaaatgcttttgaagcgtttatcggagctatttatctggatcagggatatgaacgttgcaaacagtttatggaacaacggattatcaaccgttatatcgatctagataaaatatcccgaaaagaggttaacttcaaatccaaacttatcgaatggagccaaaagaacaaaatggaggtttcctttgaattaatcgagcagtttctcgaccatgacagcaaccctgtattccaaactgaagtacgcattgaaggacttccggcaggaacaggtacggggtattccaagaaggagtctcaacagaatgccgcccagatggctataaagaaggtaaaggaaccgacatttatgtcaaccatcgaagagattaaaatacaacattcggcaactgcaactgaaatggaaacagaaatggaagttgaatttgcaactgattctgagattgaattggcaaccgggcttgagaatgaactcgaaaccgaactgaatgcaaatcccgagatagaaccggaaaatgtttcagaagaaaacatcctcgtcgatgagatttccacagtgcagggcacagaagctccggcaactaaccaaagcaaatccccatgcgacgaccctgaatcaccaaatcgtgatcttcagtaactaatttcagttttcctgcaacttcttcaagaggaatagatgctatatcgtctccttttaaggtcaccatacgcccgaattggccattggctatcaattccgttgcatgcccgcccatgcgggtagaaagattgcggtcgaaaggagtaggcgaaccaccacgctggatataccccaaaactgtttcgcgggtttctataccggtttcatattcaatttcctgcgcgatatattcagcagcacgtttacgcccatcggtctgaataccttccgctaccactacaatagaatagggtttgcctttctttaatctttccaaaatcgtattgccgatattcttaatgtcataagcgatttcggggacaagaatcacatcccctcctcctgccataccggaatacaaagcaatccaaccggctttatgccccatcacttcaatcaccatcactcttttgtgagagcttgcggtggaatgtagacggtcgatggcatcagtagcaatacttaccgccgagtcgaagccaaaagagatgtccgtgccccaaatatcattatcaatggttttaggaacagatacgatgttaactcccattgcagcaaacttggctgcagtcttctgcgttccatttccaccgatacaaacgacacaatccagtccaatttcatgaatattctgaagaattaaagacggtttgtcaacatccgagacaacgcctccttttttgaaaggcttctcgcgagaggttcctagcatcgttccacccaaattcagcagaccggaaagcgacttgtctgtaatagattcgacatctttggtcagcaagccctgaaaaccgctgtgaatgcctatcacttccatcccataataattgatggcagttttgcacacgccacgaatggtggcattgataccgggacagtccccgccggatgttaagattccaattctcattgtcgcattttttagtctaaaactcgggtattctatgaaagtcgtcaatttttaacgattatttccgtcgtaaagatagaaaaaaaagataaataagttacttttgcacgactaaacattattatgttaaagcagaaatgaatattacaaaaattattagtaagactttcgattcccgtttaaaacagatagacctatatgctagtcaggctagtgagatacagcatcgtgtgttaagtcgcttaatacaccaggccgctcagactgaatggggaagaaagtacgattactcctctatccgtaactatgaagatttccgaaaacgtgttcctatccaaacatacgaagaaatcaaaccttatgtagaacgtttgcgagccggggaacagaatctgctttggccatcggagatacgctggtttgcaaaatcctccggaacgactaatgataaaagtaaattccttcccgtcagcaaagaggcactggaagacattcattacagaggaggaaaagatgcggcagctctttatttccgcatcaatccggatagccattttttctccggcaagggactgattctcgggggtagccatagtccgaacctcaactccaaccatagtttagtaggagatttatccgctattctgattcagaatgtgaatccgcttatcaatttcattcgtgtacccagcaagaaaattgcattgatgagcgaatgggagaccaaaatagaagcaatcgccaacagcactattccggtaaatgtgacaagcttgtccggcgtaccgtcgtggatgctggtacttatcaaacgtgttcttgaaaagacaggaaaacaggctttggaagaagtatggcccaacctggaagttttcttccacggtggagtcgctttcactccttatcgtgagcaatacaagcaggtgattcaaacaccgaagatgcattatgtagagacttataatgcttcggaaggatattttggaactcaaaacgacctctccgatcctgccatgttattaatgatcgactacggaatcttctacgaatttgttccgctggaggaagtaggaaaagagagtccacgagcttattgccttgaagaagtcgagctcaacaagaactatgcaatggttatttctacttcttgcggcttatggagatacatgattggggatacagtgaagtttaccagcaagaatccctataagtttgtcatcacaggaagaacaaagcatttcatcaacgcatttggcgaagaactgattgtcgataacgctgaaaaaggattggcaaaggcttgtgccgaaaccggagcacaagttagtgaatacaccgcggcacctgtgtttatggatgagaatgccaaatgccggcaccagtggttaatagagttcgctaagatgccggattcagtagaaaaatttgcagcgatacttgatgccacactgaaggaggttaactccgattatgaggcgaaacgatggaaagacatagctttgcaaccattggaagtgatcgttgcccgtgagggattattccatgattggctggcacagaaaggaaagctgggaggacaacacaaagtccccagattaagcaatacgcgcgaatatatagaaacaatgttagcgctgaatgacagtattccttcggaagaataaccaaaaaccaagacataaccgacacaagttatccttattacagagattgcttgtacaaggagagcgtttcgaagcacctctccaatttcttccaggcacggattatgcgaattacatggataaagtttattctctttccgtgtttatccgtgtaatccgtgcctaaattatgtcggctaattaccgggcgttgactattatccctcctcccaataataagccatctttatagaatgcagcagcttgtcccggagcaatggcggttaaaggctcatgaagttgcacatgcagtagatgatctggtgtaatggtaatcgtagcatggttttcctgtttgcgataccgtattttcacaatgatgtcagaatgccctaaagtacgctcctgattgacaagattccagtctttcaaccacatttctgttttctccagagctgaaagagaagctaatactacttcgttcttttcaggattaatctctttcacaaatacgggacggttcaaatgaatgcccaagccacgtctctgtccaatggtataaaaaggataaccctcatgccaggcaataaaatctcccttttcatcgacaaaccttcctcgtttcactttattgagtcctgcctgattgcttccaaccaatacttgccaatctccaaccaatgcttgattctcccccatcatctgctcttcttctgccaatgcctcattattttgagccaaccagtttttcagaaaagttcgatagtccattgggcaaaaacaaacgcctatactatcctttttagttgccaccttccggaacccatgttccgcagcccagacacgagcttccactttcgtaatatcccccatcggcaacaacatcctgcaaagaatatcttgtttcaatccccatagaaagaaggtttgatccttatccgagtcggcagcgtatgttatataaaaggtattatttagttgtatattctgtgcataatgcccggtagcgatgtagaaaacgcccatttcatcggcaattttagcaagcagaggccatttcaggtaattattgcacaatatacaagggactggagtccgtcctgccagatactcctgcacaaaatattcaataatctgtttactgaatatttcacgggcatcgtatgttatatgccgtattcctaaacgttctgccagattacgggcatcttccagatactctgtcgagccattcaattcataaaaacggaaggttactccgatcacttcataaccggcttccagcaatcgcatagcagcaacagaactatctgtaccgccactcattccaagcaatactcgtttgttttcctccatcatgctgcaaaattaagtattttcccgtatctttgtttgttaaagtctaaaagagaatgaaagagagaccaactaacggacaagttataatcgttttcacagagcatccgatactcggcatattgctgattccctatattgcggaaaagctggacgatggtaccttgcaattggtagaacaagcatttcacgcctctcccgaagctatgagcaagatgagtgaggcagaaagacaagctattcatatcgcctcttattatacagagaagcatctaatgagtgtctactcccgcgaaaaaacagtatcgcgttttttacataaattatccgaagatccggaacgaataaagaatgatatccgtccatctatcgaaaagaaactgttggaaatgctgatactgatacgggacaacggactgcctttttatcagaaacaagccggcagtaaaatactatacgcccatcatgcctatcacataaatcctcataatgcagaaattcgtgtaacgtttcatgttgacaataaaacgtttcgttatcagttgcagtgctattatgaaggacagccattctctttaagtgagttgaaacctgtggttgtactgacatccgcaccagccacgctattattgggaatggagctatatttctttccgcacattgaaagcgcacgcatcttaccttttacaaagaaaagatcgatcagcgtagacgcttcccaaattgaaaaatacatagataacattgttatcccgattgctcgttatcatgaaatcgagactcacggtttgagtataatggaagagaaatgcccctgtgaagcaattctctcattcgaagataccacgtacaacggacaagcattgcagcttggtttccgttatggagatcagacatttacatcggatagtgcccttgaaatgaaaaaaatcatttatcggaaaacatccggtgaaatcttcttttttcgccggaacattactgctgaagaacaagtcgttcagctcttaacggatgcaggcctgcaacaactcaataatacacatttcagcctatcccctgaagctccggagaaaacgatcgtcgaatggatcaacagccatcgggagatgttgcagcagtccttccatctcaccagcaatatgggaaacacaccttattgcctggacgagatacgcatcgagcaaagttgtgacgatgaggtcgactggtttgaattgcacatcaccgttgttatcggcaatctgcgtattcctttttcacgcttccgcaaacatatcctggaggaaaagagagaatatctgttacctgatggccgcatgattctcctgccagaggaatggttcagcaaatatgcgaatttactagagatgggaattcaaacggaaaaaggaatccgcttgaaacatacatttgtaggtgccgcacagaccgccttaggtgaagaggaattaaagaaatttccggtgaagcaacagatacaaaatattgccgtacccaaaaacctcaaagcaacgttacgtccctatcagcagaaaggattctcatggatggtacatttgcataaacaaggatttggcggatgcctggcagatgacatggggcttgggaagacactccaaactcttactctattacagtatatatataaaccatctacccccagacaaccggctaccctgatcgttgtccccacatcgctacttcataactggcgacgggaagccaaacgctttacagcactctcgatggcggaatacaacaacaccatggctatagacaaggaacaaccggaaaaattcttcggtcattttcacttgatctttacgacgtatggcatgatgaggaataacattgatatactctgttcataccgtttcgaatacatcgtgctcgatgaaagccagaatatcaaaaatagcgaatcgctcaccttccggtcagccattcgactacaaagtaaacaccggcttgtacttactggcactcccatcgaaaactcattaaaggacctgtgggctcaatttcactttatacaaccagacttactgggtacggaaaatgctttccaaaagcagtttataatgccgattcgtcaggggaatgcccgcgcaaaagtattattgcaacaactgacagccccatttatcctccgtagaagcaagaaagaggtagctccggaacttccggcacttaccgaagagaccatctactgcgacatgactgaagagcagaatacttgttacgaacaggagaaaaacagcctgcgcaacatccttcttcagcatcctcaaagtaccgacaggcttcattcgtttagtgtattaaatggcatcttacgtttacgacaactatcttgccacccgcaacttatccttcccgactataccggaacatccggaaaaacggcacagataatcgaaacattcgatacgctacagagtgaaggccacaaagttttaattttctcctcattcgtcagacatctggaggtgctcgccgaagctttccacgaacggggttggaaatatgccttattaacaggatcgaccaacaaccgtccttccgaaatcgcccatttcaccgatcaaaaagacgtccaggcattcctgatttcactaaaagcaggaggcgtgggacttaatctgacccaagccgactatgtatttatcatagacccctggtggaatcctgccgccgaatcgcaggcgatcgcccgcgcccatcgtatcgggcaggacaagcaagtaattgcttaccgcttcattacccaaaacagtatcgaagaaaagattcttcacctacaagatgagaaacggaaactggcagaaacatttgttactgatagtgagccattacctatattaagcaacgagcaatgggtagacctgctctaataatacataaagtcgcaatctatcacagagacgtgtaaaatgtattatttcatcgtattcctgaatttttttatccatatactcttattttatccggttatctttgccattgtgaaaattataaataacccgaaataataaacgtatggaaaacaggagcattacctacctattactatttggtatttgcagcatgctattcgttctgcaatcttgccaagaaacggatgacctgcgttctgaaattgattcgctaaaaaatcgcgtccaagtattggaagaaacagctaatcaactgaacacttctatcgaaagtttacagtatttattaaatgatccggtcatcgtgggtatcacacctatcgaaaatggctatactgtagaattaagtgacggaaaaagtatcaccgtcatgagtggagaaaacgttaatgcgctagtccccactttatccgtagataacgaaggatactggatttatagcactgatggaggcaccacctacatgcctctaaaagatgctaatggcaataagatatatgccattccaaccagtaagccgaccgatcctaacgggccgtccacccctattcaatctcctaaactaaaagtagatgcagaaggctattggctagttagctatgataatggaaaaacttatcagtatctgaccaataatgacggcagcaaaattgaagccattgaaagtgccggaaaaaattcgatctttgacaaggtagaatatgatactaccagcaagaaactaaccattatatatggtagcgataagaccattgaacttcaagtgatcgatacattctatctaaagataaaaggtatggaaaacactcctattttcccgttaaacgaaacacgcctttatgaagtggaacaacaagatgttacaggagcggtgattaaagctccacaaggatggaatgtcgttttaaaagataatgaactttccattacttcaccgaaagcaaatgatatagagaataaagaagaaacaatcaatattattattacttcttctaaaaactatatccgcataatatctttcaaagtacgactactgacaacaggctacgatgccaacacatgtgatgtatggaacaaatttaacttaggacaagcagataatgtactgctagatttctcttatgctggttataaacatggtgaagtcgcacctcccgatgtatggtctttaggttacactgtatataatgtaaaagattacggtgctattcccaatgacggcaagtccgaccgggaagccttaaccaaaatattagccaaaataggctcaaaagtggacaatgccaaggcgataatctattttcctaaaggagaatacattctgcatacggcagccgatgatgtagatggaaaatcacaaacaattcagttattaatgggaggagtaatcctgaaaggtgacggacgcgaccaaactgtcataaaaatggatgcccctaaccaaccgaccaatccaagtgtcatgtattcctcacctgtcatgctggaaatcaagcataatagtggattatcccctattaccgaggttacgggaaacgccgaaaaggggactttctcagtagaagtggcctccaccacaggtattaaagtcggagattgggtatgtttacaactggctgataatagtccggaacttatcaaagcagaattagcaccttaccaacccacttcaaacatgactaatctacatgaagatggcgtacaggtcttcgattatcatttagtagcagccatcgacgggcaaactgttactttcaaagagccaatcatgcatgctgtagatccacaatggaaatggactatccaaaaatatccccactatgagaatgtaggtgtggaagatatgacctttgaaggaaaagctaaagttgactttactcatcacggttcatgggaggacgatggagcctacaagcctatcaatcttattcgcctgacaaattcatggatgcgccgcgtgggctttcgtagcgtcagcgaagcaagttcgatcgtcaacagttccaatgtatccgtatacgatgtggtcattgacggaaaccgtggtcacgcagctatccgttcgcaagcctcgtcacgcgtatttataggcaaagtgacggacaaatcaaacggattccttatagataacaaaaatgtatacgaacaaggagcaggccaataccacgcatgtggtgtatccaagcaaagtataggtgctgtcatttggaatgtagactggggaactgacggttgctttgagtctcatgccacacaacctcgtgcaacgctgattgaccgttgtacaggtggttttatgagattccgccagggaggtgattacaaccaaatgcctaatcacttagccgatttgactttgtggaactttaatgccaagaacaatgttgcggattctccattcatctggtgggacaacaattctctttggtggaagttccttcctcctatcgtagtgggatatcatggcggtagtattcatttcgatgaaagccaaatgaagttgaatgaagaacagggtaataccgttactccatattcactctatgaagcccaattacgcaaacgtttaggtgcagttccggcttggttaaattcactccagtaataactttaaaaacaagatacaattatgaagaaactttggtacgtatgtatgttactgactgtatgtctggtaggatgcaataagacagacgacttatgggacgacgttaacgatttaaagactcgtgttaccgcccttgaaaaaaccgttcaagatttgaactggaacattgaagccgtacgcgaactttgcaaagaaggcgctaccattactgatattgaattaaaggatggtatatataccattacattaagtaatggcaagacactcaaactcgttgaagaaaccggagcgggtgccttgattcctcaaatgggcatcgacaacgatggttattggacggtaagctatgacaacggaagcactttcacacaactgaaagataaaagcgggaatcctataaaagcaacggctgaaaatggaaagactcctcttttccaaatcgatgcagcaacaggatactggcaagtcagctacgacggtagtacttatgagaacgtaaaggactctgcaggcaatcctgtaaaagcaaccgacggggaagccgtaaaagataaatttttcaactctgtagaaaaggttggcaacaacttcaatattgaattaagagatggcacaaagttatctatccctatcatcagcaacttctactgcaagtttgatgaaagtattgtaggtatacaaagaatcgcagcaggatctacgaaagatttcattgtacacatgaagggcgtagaatcttatatcattaccgctcccgaaggttgggaagcgactttgtctgaaccgtccgcagataacgatgaaggaacattgacaataaaagctcctgcaacagcaaaaactctatcgcgtgccgtcgctgataataccaaagacgtatctattcttgcaacttcaggagcatatgctgccatcgcaaaaatacaggtagagcttggagaagcagaaacacggattgactataaagcaaaattcgataacggagaaagtataacaatcggtgatatcacatttgataaaaatacttatcccgatgcagaagtagtagagttggatggaacagaaccagaacttgacagctatatcaataattccaagaaagtcaaaatcttattcttaacaggaaataatgattttacaacaatcaatcctgtaaaccttaataatacaattattatcattgggaaatattctgattctaaacctgtcattaaacctagtagggtttggaaaacagtctctggaaatatcttcataaagaatattcatttagatatgagtagtttcactactgatggacaatatttcaacaattcgaatacttcaagtgctactgatttcacagctttgatcatagatgaatgtaagatcagcgacgttaaaaacccaatttatcaagatacagcaaaagacaatttgaatggtatcaatacgatcattattaatagaactcgtattatggtcaatgcagacaacaaagctctcatacatctatatacaaccaaaaacttggctccatacaagaaatttgcatttaccaataatatagtatacagtaaaacaccttatgtgggtcaaatattgaattggggattacaaacagactttacagaaggaaatcttactgcaataatatctaataatacagtaattaatattgcaggaaacaatccatatttcagacataataaaggtagtctcacgatgacaaaaaacatcttttatgtagactcaagttttgcaaagaatagcaacctttatacttacgtgggaaatgatactcatcctgtaagtgtaactacagtagatgttaaagataatatcgtatatggattaacaagtaacagtaaatggtataattaccatagcaactgtgatgcaagtgcgaaagttgacccctatgtattgactcctcacgccactgcaccactgaccattactgatgtagaaaacggtatatttgtcttggcaacagatatggatggatacggagcaaacatagaataagaaaacattacaacatcaataaaaaaggatatccgaatttggatatcctttttttattgactaatatcccattccgaactgccacaacggcaccacattcataaagcctctttcaatatcatccttcaccacaaatcctttctgtacctcctgaatctgcttttgtccctttttctttcctcccacctcaaatgtcatatcatcaatcaagaaatcagaaacaggagaagctactacatccgaaaaaatacgggtctggttcaaaaagaaagtctccctgatatttccaatattagaattatcttgagccagactatatatcaaattggtattatccagataaattttatctactttccctaacccgcgtattccgccggtagcatctctcaactgcgctatcaaccctgcctcttcaatataaaggcaataatcggatatattattacggctcacttcaagaattttagctatactgctaaaattaggcttgaacggcacactcttagcaatgatagcaagaagttgcttaagtttacgcccagtggaaacattcatatcagcaaattgaggtatgtccgactccaaagtcaaattgatgatctgtcgcaaacgtatatcaaaatcttcctccaatgcaaaaggatagtagcctttctgcaaatagtcatgaaagagtggaagcggatgctccaaacccggaatttccactttatgcgctacaatatcctgcaaactgtatattccagaaggaatacgatgaaataaatacaaatactcacgaaaagaaagtccctgcatctgatacatgacagcgcgacgactcaaatctgaagctcctttattaatatccaatacagatgaacctgtaaaaacaatattcaactctgaatgataatcgtaaatcaatttaagctctttcgaccaatctttatatttatgaatttcatcaataaacaaatacttgcctcccatttttacaaaagcatctgccaagtcaagcaaacgatggctggcaaaataaaaatcttcagccgtcacatataaagagtcatttaaattcagcttttctttaatgtgctgtaatacaagagtcgtcttccctactcctctaggtcccgtaagccctatcatgcgactattccaatttatcctggaataaatataccggtgaaactcaatattagtctcccgtatcatcttgtgaaaatactcaaataacttatccatatagcattggtttatagacaaagatacgattatttgcactataatagtgcaaataacaaaacaaattgcactttcacagtgcaatttcagctaaagccacatcttttcccccaccaccttgcagaaaaacttttttaatttatctttgcatccaaaacaaccctacatgaaatacaaacttatcgtgctcgatcttgacggcacactcaccaactctaaaaaggaaatcaccccccgcaacagggaaactctaatacgtatgcaagagcaaggaatacgactggtattagcttccggtcgacctacttatggtattgtgccattagctaatgagttacgtatgaatgaattcggtggattcatcctgtcctataacggaggagaaatcattaattgggaaacacaagagatggtatatgaaaatgtgttgcctaatgaagttgttccagtgctctacgaatgtgcccgtacccatcaactaagtatattaacctatgacggagcagagataataaccgaaaactctcaagatccatacgtattaaaagaggcctttctcaataaaatggcagttcgggagacaaatgacttcctgacagacatcacgcttcccgtagccaaatgcctcatcgtaggagatgccgataaactgattccacttgaagccgaactttgtctccggttacaaggtcgcattaatgttttccgttcagaaccctattttctcgaattagtcccgcaaggtatcgacaaggctctttctttggccgtcctgttaaaagaaataggagtagcgcgtgaagaagttatagccataggtgatggatataatgacctatccatgattaggtttgcaggactggggattgccatgggaaatgctcaagaacctgtaaagaaagcagcagattacatcactctaagtaacgaagaagacggtgtagcagaagcaatcaagaagttttgcaatcaacaatagccaaacatttactggcatgccggcagagttttagtttctcggtgagaaacctttggtttcaaggaatgaaactattggttcctcggtgtgaaactgttagtttcataccgggaaacaaatcacattactggtaaaaacgacccgacacttaaaatcaaccgattaaagatagggcgcatattcagattttatactaactttgcgattccaataaaacaaatataaaatgttatggaacatcaacttaccatttacaacaccttagatagaaagaaagagttgtttataccgcttcatgcacctcatgtaggcatgtatgtgtgtggaccgactgtttacggagatgcccatttaggacacgcccgtccggctataaccttcgatgtgttattccgctatctcacccacctaggatataaagtacgctacgtacgaaatattaccgacgtaggtcatctggaacacgatgccgatgacggagaagacaagatcgccaagaaagcacgtctggaagagttggaaccaatggaggttgttcaatatttcctgaaccgctatcataaagcaatggaagcgttgaatgtactttctccaagcattgagccacatgcttcaggacatatcattgaacaaatccaactggtacagaagattttggatgccggatacgcctatgaaagcgaaggctccgtctacttcgatgtagccaaatacaataaagattaccactacggaaaactttccggacgtaatctggacgacgtattgaataccacccgtgacctcgacggacaaagcgaaaaacgcaatcccgccgacttcgccctttggaaaaaggcacaacctgaacatatcatgcgctggccgtctccatggagcgacggtttccccggatggcacgccgaatgtaccgctatgggacgcaaatacctgggtgaacacttcgatattcacggaggaggaatggacttgattttccctcaccacgaatgtgaaatcgcacaatcggtagcttcacaaggcgatgacatggttcactgctggatgcacaacaacatgattaccatcaacggaaccaagatgggtaaatcacttggcaacttcatcacgctggacgaattcttcaccggtactcataagctgctggcgcaagcctacacaccaatgacaatccgtttcttcatcctgcaagctcattatcgcagcacggtagactttagcaatgaagcactgcaagcatccgaaaagggtctgcaacgtctgatggaagccattgacgcattagataagataactccctcatcggtaacttcagagggaatcaacgtgaaagaactgcgcgctaaatgctacgaagcaatgaatgacgacttaaatacaccgattgtcatcgcacagcttttcgaaggcgcccgcattataaacaatatcattgccggcaatgccaccatctccgccgaagacctgaaagacctgaaagaaacattccatctgttcagcttcgacatcatgggattgaaagaagaaaaaggctcttcagatggtcgtgaggcagcttacggcaaggtagtagatatgctactggaacaacgtatgaaagcgaaagccaacaaagactgggctacttccgacgaaatccgcaacacactgacagcactcggatttgaaatcaaagatactaaagacggtttcgaatggagactgaataagtaacaagaaaagaaagtgctcaacgcaccgtgtaaatacaaagaagaccggctccccacgaaccggtcttctcttttttcatagaaacatgataactaatacctctctttaaattcttgttttctcttatcttattcactaattatttattttccatgagcatttcgaccggctgtccatgctgacaggttactgtcagtacggtctggtctccctgctgttccaaccggacattttccatcgggcttgtcaatctccaatgtcctttaagccgtatctccttagtaataggacgactgggctctttcgttgtatacgtcttctcttctatattcagattcggatcacagacgcttaaacggatacccttatcagattcctttgcatacatcaccattgtttccgcaggaatagccacgaacactttatcagcggcaggctgataagcttcaaaagcagcatacgccgtgatacctgtctttttatcataaacaacgtgagcagtctgatcgcgttgcaacacctcgtatgcaggagttttgcgcagttcatcgagatcggaagcagaaggctgtatcaataccatatattcataagtcccctctttcggtgccttgccatgttctatccaggcagaagagaattttcccttagtaacttcacgcgtcttgtcgtgccgtgattcctgttctgccacctgtgagcgaacggttccgtccactacatgataataattgtcataaccatcatgaagccaatagttatcctctcctactttgggctccttaccattatattttgtctggaaaagagtcgtttccgtaggataatccgcattggagttcgaaatacctgttcccaggcaaaccatccggttatcaaaacagaatacggatttacgggccacaaagtctggtgtgaaattctcataatcccgttctgccaatttcatagcgaacattccatttttaccatctaaagaactgcttccggagaaattctctttggagcgtgccatagtcgttcctttcaatgggctatcaagcaaatcgaaaggcaaatgaatggtagttgtacccggcaaacggttccagtcccatccctcctgcacaaaaccgcttccggcacgtgacacgggatttcctttccccataatctgcacggagccataactctgataacgtccgtaacggttatctttcgtataaatttcagaaccccatacgtcagtggtatatcctttcaatgtcaccatccaatctgcacgacggaaaatgcctgccgaaccatagttgtaaacgaagaatccctgtggagcctgtgccggttgaataccttccttcttgaagaaacgcgcattcggagtatcactattgcgtatcagacgtaaatagtcagcagccagaccacgatcaaacgtatttccctgaccggacaaatcgccggataaagctatattggcaaatgcttcgatatcatcgcttcccatcttccctccaaaaggatgacggccactgattccgatgccccattcatagaaattgcaataattgcgcatagcaataaaggctgatttcatgtgtttgcgcgcatcttcggtcagttcaaaacttgtaccattggtaaatgcaatatattctcctacagtcgcaagtactccagtggtatatcccggatagaaaccgccatgatggaaagtcgtaccgtctacctttataccaccgatcgttcccggagtataacgcaaagaagaagataaccaacgtgataatccgctcaacgcttgcgcctgttctcttgcatcgggaaacatcatagcggaaataaatttcgccatcaataacgtatgccaggaatccaacaattcatcacgtgttggagagcatggctgacgagtttcttgcagagccgcccaaaaacgcaatgtggagagataagcatcccgatgaggatgtttatagatagcatcacgcatcagccaggcagttgtatatatcttacgtacctgataaccataatgatgattggtacccataccgctaccgtatgcaaatccctgatcgatagcatagtcgaatacggtaaagtagtttttctttgatgtttcgttctggttataataagcatcataggcaaagccggaaagcatcgtttcaatatcgttccatgacatttctcctttcttcttgtcctgttcatcaggagcaacaataggagttcctataaatcccgtcccagcgatggatggactgatagccgctttctcaaatgttttataggcagcattaataggcccttgcggtgcctttttcacttccagaaaatctgtcaaacgttgttcgatagtcttcagctccttcttttgttcgcttgtcaatttagaaggcagaggaatatcatacgactgttgttcccatttccacacgagacaccaatgccacaggtcacgattagacagcccattattggtaggcaactgttggtcgggagtggtacgaagattcattttcttttccggaaaaatcagacggtcaagaaagatacgtcccttccgttgcggggcaaccagccgataggctacgatcttcttatctttcttgtcgccctgcatatactcaaaagagatccagcaagcccgccagcctgctgcctgcaaacgataagagaaccagtaagagacttctccctccttattcagaaactcaaaacgaatagaatcctgctgcggtttctcattataaatccacaaggtaatgccgaactgcttctcgtttctcgtattcaacgataaaggagcaatttgaacatccagtgtagaaccgggctgaaagtcccattccagactactttcaccctctttgtaaaaaagagaagagattttcacttctccctttccggaaactgtaaatgcttcgggcacttcttcttcaaatccgatgagttgagcgaaagctgaaggaatgattcccaaaaggaataatactataaaacaactgtttttcattactattttcaatttaaacgcggatgcggattaacacctattattgtcgcagagatttactcctaaaattggcacttatttgagttaatcagcgttttataaattactaatcgctaataaggaatccgatccgacagaatcttttccgtataccaaggatcattaatttccttcaacatagctcccatttcaccgcaaagttgtgccacaatctccttattttcttccaaaggcaggttatgcagttgatatggatcttttacatcatcgaataagaggcttttcttcaattgcttcgtatcacggtcgatatataacgccaatgtatattgagccgtcttgatacctcttgaagaagggaagtaagtctgcaccaatccattttcatctttatcaccatctacattctgaatatacagtgcacctgtaggacgaacaatttcagccttttcatcgaagaaaagaggagcgaaattacgtccctgcacttccgccggaatagaatcacccagaccgcacaagccaagcaccgtaggcataatatcaggagcggagagcaataaatcatctaccctcggctgaatcttaccgggaaaacgaaccaggaacggaatattcatggattcagaataaggggaattcttcggatcatcagtgcgctggctacacatcgtctcaccatgatcggaagcaaagattacgactgtattcttatccaatcccaattctttcaatgtcgtcaaaatctgtccgaaagcacggtctactccggtaacggaagcgaaataataacgtgcagactccgctttcttcatcttcaaatcgacattcggacgaatcaacagactatccagaggctgatctttataaagattaaaatcctgctcttcacagtcattcaaggagcgatacgggctgtgaggaggattcatgcccaccattatgaagaaaggtttcttggtatcacgtacgttaccgtcatttttcagataagaaatgactttgcctgattcgtgcaaaggtgaccattccttcggatcgtgtctcttaccatccgtatcccaataatgcgggttcttgtgttcgtcaaatgttccgtaagaataccagtagttaaagccgtgccggcgttctttcggtgtataggcatcccatgccggacgtttttcttccacatactgtcccggatgttcgggatcgttcggagtcgggaagtcagcgtgaagtttaccaaaataagcacagtcataacctgctttgctgaacacatcgccgatacattccgcatcctcgcgtaaggaactgatcggacgtgtagaattgcaattcaatggtacaccgcttttgttcggatacataccggtcagtaacattccacgatgagggctgctcaacggacagttactctgtgcagacgacaagaccatagattcacgtgcaaaggcatccagattaggagtatgcacggggtctccttcaaagtttactttatcccgaaatccgtcctggctccagaagcccatcgcctggttacggtattgatcgggaaatacatagattatattaggatgctccgcttgttgggacgcttgcttcggagccttgcaaccttgtgcgacaaacagcgtcaagcctcctacaagaaggtttataggtttattcatgatggtttatgataaatgattaaaaacaggtaaatgacaaacggtcaatagaaagttatagacagcaagtagcgaatgataaacggtaaacatgttccgtcagaatccgctaagcattcaccgttcactgtttaccgttcattatctatttcttatttcttttccaaatctcttttacgcatcagtccttccaggaagtaatagtcagcatagttcagaggaacgtcaatttcctgaccgtgaggaatactgccaaccgaatgcatcaggataaagtttccatttgttccaacttctgcgcgataagcaggtgagcccaaactttccattatcttatcagccgtttccttgtagtggttgcccggcagatagccatccagttcataaagggcagaggctgtacaagctgctgcagaagcatcgcgcggttcgttcggaatattcggagcatcataatcccagtatggtacgaggtcttccggcaggttcttattattaaagatgaagttatagaccttttgtgcctggtcgagatatttcttgtctttggtatagcgatagcaggtagtatatccatacagagcccatgcttgtccgcgagcccaagccgattcgtcggcatatccctgtgcagtttgtctcttacgcacttctcctgtctccggatcgtaatctaccacatggtagcagctgttgtccggacggaagtggtgagccattgttgtatcagcatgtttcactgcaatattgtagaaagtagaatctccggaaagagctgttgcttcaaataagagttcgagattcatcatattatcaataatcaccggacatttccatccccgtgttccctgccaacctttatcggcatcccatgactggataacgcctgcattcggacgaaaacgagtggacaatgatttggcagcttctataataacgtctttgtactctttcttatctgccatgcgatagccgttcaaataactgcaaccgatcatgaaacctacatcatgatgccatttcagatatttcacagaatcaagagcttctgtatatttctcagccagcggcaaccatttcttatcacccgtcagattataagtcaaccatatactaccgggaaagaaaccggagcaccagtcatcaataggtatgtaagaaatgctaccgtctttgttgatagttcttggattcaggatcttaccagatttttcaataatatccgtttgaatcgtgttttgtgcaactgcgttgtcgatgttgtcctgaataaagtctacttcaacctttttttgtccaccgcaactcgttaagatcaaaagggaaagtcctaatgcgctaagaattgttttcataatacatggattgtttattaagtgattaattttcctgatggcaaaagtagtgcatttaaagagaatagaccgacccaaataatccaaatgaggaactattttggtacattttactgaaaaaattatttgcacaagcatttccaaagactttccaactcagtttggtcgtcttaacacaactgacccaacaaattagtcagcacagtatttattatctcaaaactcattcattaaattcatttctattcattgttattaaagatataaaactatattctaccgctataagactagtgtaaactcgaagtttaaatgacaacaacaccttatttcaagtacattacagatagcttctttcacgccaaaaggcaatacttaaccttttttaattctataagaagccaataagacatcgtttataggaaattagtgtatatttgcagagcataactataaaacgcatgttcaataaaaacaattacaccaacaatttcaaccaatttttcattgactatcaacgccgcttcattcattttgcctctacgtacgtgcatgatgaagccgtggccgaggactttgtcattgaatcaattatgtattattgggaaaacaaggaacgattgccttcagacataaacataccagcttatgttttgactgtcttgaagcataaatgtatagattatcttcgaaatcaacaggttcgtcaaatggcttccgataaaatctttcaaatctactcttgggagttatctaatagaatcgcaactctagaagaacttgaacctaatgaaattttcacagctgagattcaagaaatcgtaaatagaaccttagaaactttaccggagcaaaccagacgtatttttgccatgagtcgatacgaaaataaatcccacaaagaaatagcagacctattgaacatgacaacaaaaggtgtcgaatatcatataaacaaagccacaaaagttctacgaatagctttaaaagactatttgccaacaacgctacttctttttttcttaaactagaaaaccactacaactccaatcatactttttcacttcccatgtatcctatattctagaaccagaaccttttgatcaataaaagcacaaaaacgtaagtatgacatgacaaacatccacatggtttcctctccgcacgaaaaaggtgctgcaagccggaatgaaagaaaaaacacaaatacttaaaagaagaatctaaaaaaacactttcttactagggataaacttactctgttcgttattactataaatacatcaaaaaaataaagtatttatgaataagaccttactctattattttcgcaatgaaagagccaccatatatgcgaacatgaaaaatggaaaacacagctatttatattcgcaaaagtgaagagcgttcttactcaacctatataatttatatttataaacacttttattcatctaatcaaatttattatgaaaacgacttcagcattcatggctgtttgtacagccttacttatgttcagctgctccggtgatgatgaaaattcgcaatcaacacctctccaactgaaaacaacaaccagttctcccgcaaaaggagaaataggaactaagataaccattatcggtgaaaattttacagatcaagccaaagtatatttaaaaaatgccaaagctactattacatcggtaacagctacccaactacaggtaattgccccggcaaatgaagcaggagaatgtattatagaagtaatggtaggtgcccaaaagacagagaacttaagatttacttacgtagactacactcctgttgttagctccatcagcccaagctccggaacagaaaacacggaaattactatcatcggcgagaacttcagtaccacccccgaagaaaacattgtaaaaataggagatgcaatagcaactgttaaatatgccacagagaccgaattgaaaattatcgcacctcaaaacgaaataggaacttatgcagtaaccgtctctgtaggtgtaaaaacaggcaaaaatccggctcttttcacatacgaagatacaagagagaggatttacgaatgtacacaaaatttcatcactgtacctagtgatattaatacccaggatttaaaaagcgttacattcttaaaagatggcagattagcttacagtactaacggtggtagtgctacagaggcttgggcaatagatttaagaacaatggaacgagaaaaaatcgtccccaatggcacaggaactgttctgctgaaaatcaccactaatcctactaatggaaaactttacctcgcatataaaggagaagataaaattagcgtatgggatcctaatacaaaacaagtttccgatttgttaactcgcaacgggttggacaaccttatggatgtaaaatttgaccaatacaacaatatgtatgcggtttgccgtaattccggaacgatccaaaaatatccatcaggaaattataacagcagttcaaggttggaatttgttaaaattaccggccgtcaaatacaagccatagcttttgatgctgctggtaacttgatagcagcagcaacagacggatcaaatgccggctatatttataaagtagactctagcggcgcttatacattgattgcaggtggaggtaacaaagttataacggaggatataacagaagatcctaaaacagccaaattggaaaaagcagaggggctaatggtagataaggatggctacatatggttcagtgacggtaatagtggcacccgtaaaaccaagatcctaaaacctggaaagaatggttatcaggacgccacaatcatcctcgtttgtaaagccgaaaatggttggaaagattcaggcaccactagtccggttgactttgtacaagatacagatggaaccatatacatagcagacggtcctaacaaagctatacacaaagttaccatcggctacaaataacatgtatcaaatttacccaaattaattaacgactcaaataacctgcacacacagcttctataacctgtgtgtgcggctaaacttaaaaaattgtacaattgcaaaaaatgagttttccactagggataaaccctctttgttcgctatcattataaaaagcacctatggacaaaaattcattataccgatttttcgagggacaagcatctattgaagaaatgaaagcagtgaaagagtgggctgaaagttcagaagaacatagcaaacagtttcaccgagagcgcaagttattcaatgcaatgattcttataggaaaccctaaatggacagcaataaatacaacaaaaagaaacagatatttcatcagggaattcttaaagattgcttctgtgataatcattgcggtaagtattacagctactatcttttcaataacgaatgagcatcataagcatgttgacatagctatgcaaacaataatagtccccgccggacaacgcgtaaatattgaattgcccgatggatcaaatgtttggctaaatgcaggaacacaaatgcaatatcctgtttcattcatggaagataaacgtgaaataatattagacggagaagcctattttgatgttgcccgtaacgaaaagtgcccgttcatagtacatactcatgcaatggacatagaagtattgggcacaaaatttaatgtagaggcttatgctaaacaacaaaacttcgaagcttctttaatacaaggaaaaataaaaatcaaatcaccttccgacaataatatttcacaagttttattacctgactataagagcaccctaaaaaatggcaaattagtgataagcaaaattgaagattataatatatatcgctggaaagaaggattgtattgcttcaaaaacaaatcgttcatagaaataataaaagacttggagaaatattataacctgaaaattatagtagacaagcctagcattaccaacataatattaacaggaaaattcagaatctctgacggcttggattacgcccttcggatattacaaaaggatgtaccttttatttataacaaacatacaacagatgacatcatttatataaaataataagaatattaactcaataacacgggagaaacaagcctatgaaatgatactaattgaaaaacaaaagagctgacagatatttgccctatctatcagcttctgcctaacacaatttttataaaatcgtattaataaatcagttacaaatatatgaaaaatatttctttattggatttttactgcaaaaaaaatccaaattcaatacaattatttagaattatgcgaacatctatatttcttttgttattctgctcatttagcttaatggcaaagaatgcaaattctcaaaatgccaaagttacaattaataagcaagatgtcagactggaatctatattgagtgaaattgaatctcaaaccaattacttattcatctataaaaaaaatgtagatgtaaatttgcacaaaagcatcagcgtgaaggccagacccgtttctgaagtattgtccatattactacatgaatctcctattatttataaaatagaaggaaaccatataatactcactaaaaaagaaattacccaaaccccgacaataaaaaaaatcaccggagtggtaacagatagagccggggagcctttgatcggagttacaataacagtaaagggtatatcacagggatcaataactgatataaacgggaagttttcattatcagccgacattggtgatgttcttcaattcagttatataggatacattccacaaacaataaaattaaagaacttgaatagcttaaaagtctttttagtggaagatgttaagaccttagacgaagtagtggtggttggttatggctctcagaaacgaactaatctaacaggagcaatttcgaccgttacatctcaagagcttgtagacagaccggccagtagcgttacacacatgctacaaggacgtgtacccggtctcaatatcaccacttcttccggtgtaccgggtaatactgcaagctttaatatccgtggtacgaactcaatcaacggaggctcaccattggtgttagtcgatggagttgaaggggaccttgaccgtgtaaaccctaatgatatagaatcaatttcagttataaaagacgcctccgccgctgctatttatggtggacgtgcttcattcggagttattttagtcacaacaaaatccggttcttctgatgggaaagtacaaattagctatagtgggcgtgttggttggacagaacccactacatctacggattacgaaaaccgtggttattaccatgtttctttggttgaccagttttacattcccaataacgggcgtcgctatacctcgtatacagaagaagacatgaaagagttatgggaaagaagaaacgacaagacagaagatcctgcccgcccttggaccgtattggataagagaaacggacagaatgtatacttatactacgccaatacggattggtggcaatacttgttcaaagacaagaaaccattgcaaagccacaatatttccatatccggaggaacaaacaaattgaaattttacctttcggctggttataatagtgaagaaggaatgtatcgaagaaatactgacaaattcagaagaataaatttccattcaaggatttccgcagatattactgattggcttaacattagtaacaatactgaatttttcaattctaattatacttatcctggattgggaggtataaattcgaacatatctcaagcccagaaccatggtttggcaagtttccctacccaaaatcctgacgggacaagcctttatactacttcactgaccgactatgccattatggacggtttattagtcatattagacagcgaagggttcagaaataaaactcgtaaagataacttcaagaccactacagaacttacattaaaaccattgaaagggttggagataaaagctaacttgacatacatgctctataaccaatacgacatacgccggcaatctaatggaacatattccaaatatccgggagaaacatccatacttaataccggtaatttccaaaatcaaatgtttgagcaatttgcccccaatgaatattgggcaacgaatgtatttgccacataccaaggttctgtatccaacaaacataattataaagttacaggtggttttaattatgaaactcgttacaacaagactgttcgtggcacaggatataatcttctttccgatgttttggatgattttaacctgataggagtagatcctgccacaaaccaaaaacggatggaagtgacaggagggcaaaatgaatataaacttgcaggttttttcggacgtataaactatgactacaaagggatatatttacttgaactaagcggacgttatgatggtacctctcgttttgcttctggtcatcgctggggattctttccttctatgtctgttggttggagagtctcggaagaaaagtttttcagcaatatgaaagactggtgtaacaatttaaagttcagatactcttttggtagtttaggaaaccaacaagttggctattatgactatatccgcactatcagtataggaactaccggatatttattcggaggtgcgagaccatcttacgcagacatttccgctccctctgccgacaatctgacatgggagactgtacaacaacataatgctggtgtggatatgacatttttggacaacagattaactttcaccggagaatattatattcggaatacaaaggatatgcttaccgccggcatcacattacccgccgtatatggcacttccgctcctaaaatgaacagtgcagatatgcgtacaaagggctatgaactctctgttgcttggcgagatcagtttaagttaggcaacaaacctttctcttatcaactgagttttacattcagtgattacatcagtgaaatcaccaaattcgacaaccccgacaaactattagctaagacttattatgaaggaatgcggattggtgaaatatggggatatcgcgtcgatggcttctttgcgaccgatgaagaagctaagaactatgaagtagatcaaagatctgtaaacaccactatcaatagttcatcgggtgaataccggggagtacgtgccggcgatttaaaataccgggatctggatggtaacaaaactataagtatcggtgaaaacagagtcggaagctccggtgaccgcgaaattttaggaaatagttctccacgctatcaatatggcactaacttggctttccaatggtatggatttgattttaatatattcttccaaggtatcggccacatagattggtatccaggaagagaagcccaagcattttggggatattacaaccgcccctacggaacatttattccgaaggattttcaaaaattatgttggtcagaagataatcccaacgcttacttccccagacctagaacagctgttgcccttacagaaaattcggaactttcaacagtgaatgaccgctatcttcaaaatattggttattgtcgattaaaaaacctgacaatcggttattcacttcctaagtttctgactaacaaaataggccttgacttagttcgtctttatttttccggagaaaatcttgcttattggtcaccaataaaaaccgactatgtcgacccggaacaagccagacaaggcggaactttgaaggtctatccttggcaaaaaagtttcacatttggtgttaatattaacttctaattaattttgactatatgaaaaataacatattcttactcatcgcagcttcaatatttatactgagctttagttcatgtgatgatttacttgatgtaacgccgaaagacaaaatcactccagaaacgttcttttctaccgaagctgatttacaggcttttagcacaaatttctacaattctctccccaaagacagagatctttataaagatgatgccgataatataactcatagtactcccaatagcgcggcaacagactcccgtacagttccagcttcaggaggaggctgggaatggggatacttacggcgtttcaacactctattgcaatactctgtcaattgtaaggataaaacggtcaggacacgttatcaagcattaacccgttttttcagagcatatttttatttcgaaatggtaaaaagatttggggatatcccatggtatgacacagaattattcgtttctgaaacagaccaattaaacaaaccgagagactctcgagaattggtcatgaaaaatatattggaagatctcgattttgccatcaccaatctttctacaacgccttctgtttatacagtaacaaagtggacagtattgtctcttaaatccagagtttgcctttttgaaggcacattcagaaagtaccacaatttaaatcttagcactaatgccgattttttcttgcaagaatctataacagcctctagagaattaatgaaggaaagcaattataccttatatacagaaggtggaacgaaccaggcataccgaaaactctttacttcacaaaatgctccaacaacggaagtaattatggcaagaaattataatttaacgtatgatatatacaatacagttggtacatatcacacaagcgtaggtgaaggacgtcctggagtgactagaaaaattatagctagttatctgatgaatgatggttcccggtttacagacaatcccaattgggaaactatgacttttgtagatgaatgcaaaaatcgtgatccacgtcttgcacagtctatttgtaccccaagttatcagcccatagtatcaaacagaaaaaatattccagaccttaatgcttgcgtgaccggatatcagttaattaaatatgaagatgaagcagtaggaggaaaaagtgatattgatctcttctattttagacttgcagaagtttaccttaactatgcagaagctttagctgaaatcaaccaattaactcaagacgatttggatatttctatcaataaattgcgcgaccgtgtaggaatgccccatctcatcatgaaaacagccaatgcaaatccagacccctatttattagcaaacactaccggctacccaaatgtctccggcgctaatcaaggggtaatcttggaaattcgtcgtgaaagaacaatcgaattgctttctgaacattttcgttatgatgacatcctgcgctggaaagccgggcaaaacatgaaacaagccatattgggtatgtattttccatctcccggcgaatatgaccttaacggtgacggacaaaacgatatttgtctttatacagacacaaagcctggtaatgcacaaggtataacatacttaaagatagattccgacattaaactttctgatggaaataaaggttatctatctcctcataaaggcctcacgcttttctggaatgaacaacgtgattatttttacccaataccctctaatgaacgtctcatcacaaatggtgcacttacgcaaaatccgggctgggatgacggcttaaatttttagtcgaaaatattcaataggaaatcaagtggagctattgcaaggatgcaagttttaactctctatttatgcaataactccgctttttcacctgaattcattttcaaacttaccatctcactaatatatggaattataaaatactaataattaaaacaagacctatgaactctaaaagaaatttcatttacaacttctttcttctttcatttttttttattggttgctccaattcaacaatagaagatgaactagaaatgcctccatttaacaatgaaacgccatccaactctctttgcgtagcccaattcaatattcgctatgacacacctgaagatggacaatacgtttgggcaaaccgaaagacaatggcaaaagaaatcatcacatcacatgattttgatatctttggcgttaatgagtgtcttttaaaccaactgaatgatctgttagaattaaaacaatatgaatacataggtacaggtcgtgacgatggaaaagaagctggagagttctgccctattctttacaaaaaagaaagagtggaattattatatcatggacaattttggtattcagaaactccggacaagccgtctaaaagttggaactctttttgcaaccgaatctgcacatggggtaaattcaaagataaaaagacggacaaatattttttcttcttctcatcgcattttgatcatgtcagcaatgaagcacgcgtcaactccgcaaagttacttgttcagaaagtacaagaaatagcaggagatctgccttacttttgtaccggtgatttaaactgtgacccagatgaagaacctatttcctttattctaaattccggactattcaaagattcttatagcatatcagagactaccccgaaaggtcctgcaggcactttgcattattggaatttcgatttcaacccagaacatcgaatcgactatattttagtggaaaaaagcattaaagttctctcctttgaaaccattacggatgatgcgcgtcaaggacgattttcttccgatcattatcctattatgataaaagcagaattataatgaagacaaattaacgtgagcctgacatagtgagtgcccatagactagcaaacgtctgcataccaagaaggggcctcacttctgtttacacattcgattgccgacagctgttaatagttaaaaacagttgccagtatagtttttgtcaaatttgcacacaaaaatattaccataacacaatacatatgacaaatgaatttgcagaaaacaattaatactcaaaaatatatgaactataaaaaatggattatcggattatgtatactcaatatactaccagctctctctcaagaatataacatagaaaatattcatattgatggctatatcggcaatcgcattaacacctgcatagaacatcgagtaaaatcccaaaatacagaccacctaatcgagcctttcaagcatcgaaacgaggatcatctctggcaatctgaatttttcggaaaatggctactcggggcaatagcttcataccaatatacaaaggataaagaattgtataatttgataacaaacagcgtagaaaagctcatgaatacccaaacaagtgatggatatataggaaattacaaacgagaagcacaactgaccaattgggatatttggggaagaaaatacacttcgctctccttgctttcttattataggctcaccggcgataaaaaagccttgaatgcagttgaacgactgataaaccatctcatggaacaattacaaatacataatattaatattgctgcaaccggttattatttaggcatggccagttgctccattttggagcctgtggtttatttatacgatattaccagaaatccccgatatttatcttttgccaaaagcattgtttcttctatcgaacgggaagggagttctcaactgataactaaaacattgaaaaacattcctgtttctgagcgttccgcttttccaaaatcttggtggtcattcgaaaatggtcagaaagcttatgaaatgatgtcatgttatgaagggctgatagaacttggcaccatagtaaatgatcctttttacataaaaattgcagagaaagcagtaaacaatatccaagaagatgagattaatatagcaggttcaggagccgcttttgaatgctggtataaaggaaaggagaaacaaacattgcctacataccataccatggaaacttgcgtcacatttacttacatgcaactatgtcatcgcctgctatgcaaaaccggcaactcgttctatgcagaagaatttgaacacaccatgtacaacgctttgatggcaaccatgaaaaatgacggcagtcaaatctctaaatacagcccattggaaggtcgaagacaacccggcgaagagcaatgtggtatgcatataaattgttgtaacgccaatggaccaagagggtttgctctaatacccaaaacggcttgtacaataaaagacaaccacatttatctcaacctctatttacctttacaggccactatttcactaaataaaaaaaataaagttcatttaaatgtagagagcgattatcctatacatggtaaggtaaatgtaaacataggagtacaaaaaaaggagaaattcacgcttgcgttacgtataccgactcaaatagaaaagatgaaagcctatataaatggagaggagcaggaaataacgcataaaggaggctacctatacatagaacgtatctgggaaaatgcggataaggtgacacttgatttcaagatagaaaccaaagtcgtaaaactaaataattctcaagccatagtacgcggtcctttacttttcgcacgagacagtcgtttcaacgatggtgatatagacgaatgtgcaaccattaagtgtaacaatcaaggtgtaatacaagcgaaaattaaaaaaaacaaaacaggaaccttcccttggatcacacttacagttcctgccgtattgggtacggatttagaaaacgtagaaaacaagactcccaaacttatcaatttttgcgacttttcttcttctggcaatgattggaatcccaatgggcgttacagggtatggataccacaaacattccatgccatgtccgaaccttataaaaagtactaaatatgatagcctggcttgaaggagaaccagccattacggaatattaatcgtgttataacaatgaaaaaatacaataaaataaaaaagatactatttacagctatttgtggagggttatttatcgcctgccaacaaccgcataatgtcaatgacccgctacaggtcctttgtttaggaaactctattacaaaacatccgataaaagaagatatcgaatggttttccgattggggtatggctgcttccaatatagaatatgactattgccatcaattggaaaagatgctttgtaagtatcatccgaactcaactgtcacccccttaaacattgcatcttgggagcgtaatctatcatgcgatattgactccctaattggatcttattgcaaaaacaaagatatcattattatacgtttaggtgaaaatgtacaagatgttaccacttttccagatgcaatttcacgacttgtgaaatattgtcagagcaaagcaaagcgtgttattattaccggttgtttctggaaaaacgacagtaaagaacggagcatcattcatgccgcacgaaccaacgatcttacttacgtgccactctattggatagataatctatataatgtccgcccacaaataggcgatacactttatgacataaataagaagccatatgtaatcactcaagattttatcataacgcatcccaatgatgaaggaatgcaaatgattgcagagactatttggggagtaatacgttaatttaacacacccctctacattttatgtgattcatgtttcttacagaaaaagcacttcttctttctgcgagaaacttagaatttcaaacatacttttaacgattataattatatgaaacactttaacaatatccctatagtaacaatactcttgttttcttatatcctaaccttatattcaataaagacacacgcatctgctttgacttccgaacacgaaatctacaagggatttattaatccaccacaagaagcaaaaccaagagtatggtggcattggatggacggtaatattacggaagaaggaatctataaagacttattatggatgaataggatcggaataggaggatttcatcaatttgacgcttccttgtataccaaaccgattgtcaaagaacggcttgtatacatgactcccaaatggaaaaaagccttccgctatgccatccatctagcagactctttaaatatggaagtcggtatagccagtgccccaggatggagctcaacgggaggtccttgggtaaatcctaaaaatgctatgaaaaaactagtgtggcgaacattcacggtagaaggtcaaaaaatgttttccgggaaactaccaagcccatataccacgacaggggaatttcaaaatatccccatacgaaacatgaacaactataccgaatattacgaagatattgccacgattgccgtacgattgccaagcgaagaattatcgttaaatgagttagatgctgaaataacttcaagtggtggtaatttctcactacataaacttacagacggagattttacaaatgccgagcttctaccgttcaacccatttgataaatatggttggatagaatattcttttcccaaaccgcaaacgataagagctttatcttttgtcagtggccgtttgcgtacagaatggcgttcagaatctcctcaaacagtaaattttctacaatgtagtgacaatggggttgattatcggatggtttgcggaattccggatggaggtaatgctcagcaaaccatatctattccggaaacaacagcacgttatttccgggtacttgttcctaatcctacaaacaatgctccgggtactcaaataccagaatttgtattacacccgactgtaaagataaatcacacagaagagaaagcggggttttcttctccgcacgacctgatgaactatccaacaccggaaacaaatactcccattgataaaaaaaatgttattatattaacgaacaagctcgactcgaacggcattttaaaatggaatgtcccagaagggaagtggcgcatttaccgtttcggctattcacttacaggtaaacgcaatcatcctgccccagccgaggctaccggtttagaagtggataaacttgatccggaaagttggctttcatattttcgcacttatatggatatgtataaagaagctgccggcggttttatgggaaaacgcggaatccaatatattataacggatagttacgaagcgcattggcagacttggaccccatcgttacctagcttctttaagcataaatatggatatgatttattaccttggttgcctgttttaaccggcgaaatcatagaaaacacaagtgaaagcgagtgttttcttcgcgattggcgcctggctatcgcagaattgtatcgtaaaaattatgaccgcataaattctattgtaaaagaatatggtttaaaaggacgatatacagaagctcacgaaaacggaagagtatatgtaggtgatggaatggaaataaaaagaacggcaacattccccatggcagcactttggatgcctaattccggtgcctgttcatcacaacagatgggacaagcggatattagagaaagcgcttcagtcgcccatatctatggacaaaacattgtagcagctgaatttggctctgctatagcccaccatgcatatgcatgttgtccagaaaacattaagcctatcgcagataaagctttagcaaacggattaaatcgttttgttattcatgagacatcgcaccagcctgtggatgataaaataccgggacttggattaatacaatacgggcaatggtttaaccgccatgaaacttgggctgaacaagcaaaagtatggatagattatcttgcgcgcagtagttatatgcttcaacaaggtaataatgtggcagacattttatactattacggagaagataattgtattacaggtttatatgcacatactcttccggacatacctgcaggatatgaatacgactttattgacccatatggatttgtgcatgatatcaagatggacaagaagtgcttgttagctccttccggacgaaaatattctattttaatattaggagagaataccaaagtaatgtcactcaaagtattgaaaaaaatagcatctttggtagaagaaggtgttgctgttttaggcagagaacctatttttcgcggaagcaatttggataatgctgatgaatttaaagcgttagtaacttccatctggcataccaaccgaaaaaacgtctataccgatactcctatagaagaaatcctggaatcaacaggtgtgcaaccggactttatataccgcaataataaacatataactttaaaatacagacaccgcttgcttgatcatggtcatatttattgggtcagtaatccttctgataaagagttatatacggaagtttcttttcgggtatctggattgaaacctgaaatttggcatcctgaaaccggactttcagaggatgtttcttatgagatgaaggacggacggactattgttaaattctcaatggtacaaaatgatgctgtattcgttgtatttataaaacccactaaacgtataaaacaagagattcctttacctcacaaaaaagaattaactacaattgattctaactggactgtaaaatttcaacctaaaataggaaattccgaatctcttttaatggatagtttagtttccttcaccgactactcatctccttccatccgatacttctctggaactgctacttatactaactcttttattatcaaaccggagaattataaaaaatcggataagctattacttgatatgggatcagttaaaaatattgcagaggtttatgtgaatggaaaaatatgcggcacattttggaaagctccttttattgttgatataaccgctgcaatcaatcctggagaaaatactctggaaataaaagtcaccaacctttggagaaatggactaataggtgatcaacaaaaaggtgtaactccccaatattatacatcctaccattttttcaaatctgattcggcattactaccttctggattattagggcctataagattaataaaatattgacacatctcattctttaagaaagtatctgaaaatgaagtgacccctaaaagttagacaaaaaattttaggagtcacttcattttcagataccctcttctcaattatataatattgcaaactatatctataattcgaatggctacagatgagttgccttgttcagccaaatggctaatccggcttcttactttaaactctcacaaatttccgtatttgccctcttcaatttctgttcatccagttttattactttgcggtcgtatgtcatcaatccgttcacttcgatctcaacatctgtagtctgtgtataaacagcagccgagaatccgcgtgcaatcatatccttcagcatattagcatacttcagatactcatcagtagcttctttggaagtactaaactgaacatacccccaattacgattcggctcccaaagatgctccttcagcactaaaccaattcctccatactctccgagtacagttgcacgctgtgcgtcatataaatacatctccggaccgggataattatgcaaatcgagcatatcaccacaggtataatgattacctccactggcaggattcactaaacgggaaggatcatattgctttgtccattctgctatttcaggggttttaaactgcccccaagcctcattgaaaggtacccatgtgccaatacaaggataagagtaaaggcagtcgataatttctttccattctttacgataaatagcctctgattcagcagaccgtttaaattctgttccctcaaaatacttccgattctgccactcgggattcttatcaccactcggcatgtcctgccacacaataacccctaaacgatcacaatacgtataccaacgggcaggctctacttttatatgtttgcgaatcatattatatccaaaatcttttgtcttttgaatatcatatactaaggcctcatccgaaggtgccgtatacaagccatccggccaccagccctgatctaaaagaccaaattgaaacaagtccttattattcaattgtagacgtacaattccatttttatcgcgtttcgttgaatatttacgcatggcagtatagctcttaaccttatcgatcaacttattttctgaatacagacaaatttccatatcatataaaaacggagaatccggtgaccaccactttacatcagacggcatagcaatttcaaccggaataccatttacggaacttcctacagccaccaactgctttccttctaataccttcacctccaatttatctgaaagcatctgatgatctgtcataacctctactgtcaacttattcctgtcaatatcaggagtcgttttgatattgccaatcgaccggattggcacaggttctagccaaactgtttgccaaataccactgacaggagtataccagatacctcccggcttactaacctgttttcctctaggctgaggacctttatcagtcgggtcccacactttcacgatcaattcattttccccattcagcaaggcaggcgtgatatcaaaagaaaaaggagtaaatcctcctgtatgttgtcccacctttaccttatttacccaaacatccgctttccagtcaacagccccaaaatgcaataagatcctatgtcctttccatttggagggaaccgagaattgacgctgataccaaagttcattcttctccccaagacttttccccactccggacaagcttgattctacagcaaaaggaactaaaatccgaccatcataactttgtggcatagcttgacctaccggagaaatagcataattccacaatccgttcagatttatccagtcagcacgttccataattgggcggggatattcgggcaacacgttttcaacatctattttcgccgcccattccgtcataattcgaccgccaaccggtttccactgtgcaaatagataaacactattaataagtatcactaaagaacatacaatttttctcatctacattatttctattaagagtatttttactaggtcaagttattccaatataatatcaaactgatcgtacggtgccgtacgatgtgccagatgcctggtcaattttgaaatcccaaacaagggagaataagtacgtactttgatcgttttaccatccggcataaattccagaatgcgaagccaaccatcccctccgttcccttccggaccgcctcctacatattgtacattaaacgtcatttgtgatacatctttcccggcactgttcttatccacccgataagccacattattctcatattcaccggtaccttttcccacatgtccgcaaagtacgagacggatattggaagaaggataaataagtttctcccaaatagcctgccccgagttttgtggagaaatcttatacccatctttcgtaacacgcttattacctatatcaagataagaatgagtgataaaaatcaccttatgattcttgtatttcggcttgtttaccaaatctttcgcccattgcagaacttcatcacgaggcacaaactctactgctataaccaaaatctttccccatcccggctcatcaaactcaaaagccgaattctctaaagacgccctgccttcacgattaggaaattcactgacacagatattccgccaggtagaatttcgttcaaaaggaatataatcaggaaaataagtacgaccgttttctgcggctttgtatccataatcatgattgcctgcggcaataatataaggtactttgttatccagtcttttcaaagcctgcgatgctgcctcccacatttcacgactggtctggttcagcatcttacggtttaatacattattatcattctgctccaccaaatcgcctgtacaaaggacagctttaattttaagcgactctatattgtccgcaatccatgcggtacaaagatcaaaaagcggctggttaatatcatacttggtatatccctgtggatcaccgagcaaaatcatagaaaaggattccggattgaccaatttctggggatcagcccgatgctgcgccgggagacaagtgacagaagcacacaatatcccggccaataaatagttgaatagtttcataagttactctttttcttctttgtttttaaatacaggtgcacgagatacggatgccggtgtgccattagtaatataaggccagccatcactgctccattgtatgcggtcacacatcagttgacgaccattatctattttcgctttctgccaagcatgatagaagaaccagtcgttcccctcgtcatccgtgataatttcggaattgtgcccggttccggcaaacaggttattaccctgtagaattacttcattataactactattttctttcatcacagtaccgtttttacccacataaggaccttcgatatttttagaacgccccaccactacacggtacgtacttctttcctcttcacaacaactacccgtagagccaaatagataataataattcccgcgtttatgaaccatgatgccttctattgaaggacccgctatcttttcggaaacagcacctttaatggatagaccgtcagcacttaactctacataacggatacctccttcatagcctttagaagtactattataacttccccagaaaagatacttcttaccattatcttcaaaataacaagggtcgatgcactgcatagtaccagaattgtagtcaagaagttttccgtgatccgtaaaaggtcctacaggagagtcgctgaccgccaccccgatacaactattcttaggcaagtcccagtgcccgagagtataatagagcacatatttgccattgatatagttaatgtccggagcccataagcgagtgtccggctgccagttcggtttttgcagaaaggctgccccagcataagtccactgtgtcatattagtagatttgtaaatcggaatatagatattatcctgttgggtaacatacaaataaaagttcccgtctgccgcatgaattattgtcggatcaggcaactgtttgccgactataggattggagaatgaaacagggttaggggtactccccccacccccatttccattaccgttacccggcccatccggttgttcgtcagagccaccggaacatgccatgatacacaatgctgttgcaattaaaaaagataattttttcatatatactttattagttaaaactaagattaatttatccaaccttcattctgttccaaattcgagttcatttccatttctttagcaggaataggccagctccagcactgatctcccaaccagtaccaggtataagtcgtttcaccccacatctgcatcagaccgttacgattattatcaaacttcttatctttccacgttccccaacgcaattcatggaaatacatggaatcttcgccaccgatttcccagtaatactcattccggatacgttcacgcaaatcactctgcccgttaactttcgtagcaggataagttgcattattcaattcgacatgccctgcacgacgtcttacttcattaacacatctaattgcttcgctttcatgggtacttccccattcatttagcgcttctgctttcaggagcaatacttccgcatagcgtattaatggaatatccaatccataagtatcacgttctgtctgttccagaccttcaggtacaaactttctccataggtagtaaaacttatcgtttgtatcagtacggatatcaaaaggctctgcactgtcggagccacgataaggccaacgcaatgtataagtatgagctattccagaagaagcaccattgtattgtgcgtaaggggtaatgacagccatttgcagacgtggatcacggctctcgtaagctttcttgatacgtgcttcattgccactatccagatatttgttcatatctgccccataggcagccatacgttccttttccgccgcagacagtccatcgcgtagaaaaaacaccacacgttctttttctttcatcgcactatagcccggcaagtagttatcccaattaaacttttctccggtcgccgtctcaaaagattctacaaaatgcggattaggcaaatagttattccacatagaacctgctgtacaacggttgccgtaagtgatgttccttgtattggagtagccgtattgcttgatgcattgcacagagaatatcatttcttcacattgttcatttgctattttcaacaactgcttataactggtagcaccggccttagtatataacccgaagccacagtcagccacagaattaaaatcatcaaccgccgcctcccaattcttctgccacatatatacttgtccgcgtaatgcataagcagctcctttggttacccgtccatagttagagtcacccgaattatatttacccggtagattgggttcattcacacaatctgtcagatcctggagtacagccgcccaaacatccgcttctgaagaacgggctttgttaccgttttcaggactcgtgattgcattcatatataacggcactcctttatacaagatattcaagcgcatataagcaaatgcacgcaagaatttacattcggcgatagcccgttgcttctctccggtcgacatatcaggaacctgaccaatattatctatcacatcattagcacgatagataaaagtataaaaacgtttataaatatcactgaacaggccacttgagggagtagctgctcctgtacaattaggcattcgcttaatccagttcttgtctgtatccatcacagaagaataagcatcccatggaatccggtgcgaatccaaaatgccggagttaggacaatattgatccagaaagacattatatacgccgataacagcctgttcggccaaagttgctttcgtccagatactactaccgcttatgttattggtaggagtagtatctaaaaagtccgcaccgcatccagccatagagaaagacagcaaggcaatagatgcacatcttactaatttccgaaatatttttattttgtttttcatcataaaatcgttttagagtaagtttagaaagtgatatttacaccgaatgcatattgtctcatagtagaatatcccactgcggtacgcatttccggatccattccttcatacccggtaatggtaaataaattttcaccggaagcaaagaaacggatattctgtgcatatacttttttcgacaggacagcaggcaatgtatatccgatagtcaggttcttcagtttaatataatcccctttttgcaaatgtactgatgactgtgtcataccactttggtcgttaccggagttatttgtcaaacgaggattctttgaactcaagttcgtgcgcggatcattgggatttttgggatcaaagaaatagtgatcgtttgctattgcttccccgatagcatatcctttgatggtagcactgctgttcaatgccaaacgatagtagtaaatcttgaaacctgccgcaccggaccagttcatggagaaatcgaagcctttccaattagcgcttgcctgcagaccgaagttatacttgggcacattggagcatccctgaaactcattatcagcgtcattaccatatacaccgtcgccatttaagtcagcatagatgtaatcaccataccaaatgccactcttactgacgttctgacgcggatagaacttataccctgcccctaccatagcattcagccatttcatgtcgtctactgtacggatcattccgtctctcggaccaccgttgatattgactgttccatctgcgttaaaaccgtttccactgcccttgtatggttgcaacatatagtattcattaatcattttaccctctattacacgggtagatcctccggtagagacatcgccgatattggtttgataaacacggttcccgttttcatctgtcacccagccacgctgcaactctcctttgtatttactgaccttgttctggttataggcaaagttaccggatacacgatattctactttaccgatacggtcttgccaattcagggtcatttcaataccgcggttagtcacttccgcaatgttctgacgagggccactggctgtcccgagagacatatacatatcagggcgatataagattccatccgttactttattataaaattcagcctcaaacgtcagacggtttcttaaagttgcaaagtcgataccaatattcgtaatggcagtactttcccactccaacaggttgttggaaatagaagtaattgccaaaccattattaaggctacctccaaacgcgtactttgccgagttgtacacagcctgccattcatagttaccaatcgcattgttccctaacttaccccacgaagcacgtaatttcaggttgtcgataggaagtcctttcataaatttctcttcactgattctccatccggcagagaaagatggaaaaagtccccagcgattatccggagcaaaacgggaggaaccgtcataacgcatattaacctcgaataaataacggctgtcgaaagcatagttaatacgaccgaagtaagaacgggatgtaaattcttcacctgtaccacttatggaagaaggagtagtagctgaacttggatcacccacagacgaatctattaatccaagttttgcggtgtcggtagtccgtttggcaaaacgttcttcttcaaaacccagcaacataccaatatcatgtttgtggaaagtctggttataattgagcaagtgtgttaatttccagtggttctcacggacatacgccatacgggtatacaaatcggcaggatctttgggggcagctatccactgatctgtactaaaactatatttcccataatccgtatttacggacatcgattcataacgataatccttatagttcagattaacatcgtatgagaagtgtttcagaaacttcacgttggcatagaaagtagtgaagaactgcgtgttcttgatatgcccttccgattgcgccatgtcccacagaggattgtgagattgcggatcttcctcgttcgcttccggcgcaccatattttccatcataatatggatatacgcccggtatcattttttgggtattgatattggtgagtgaaccggtatcgcttttcttctggtcggtgtgatacccccatacgcgagtaccaatacgtaaccacttagtaatatccgaataaacattggcacgcagaaaatagcgttggtatccggtatctttgattaatcccgggttgtcggtataagatatagaaagattatatccggtacgtccctcctgcccagtgacggaaagcgaatgtttcatcatccagtcattactatatatctcatcgtaccaatccgtattgggataagctacataattaggatagccggaggcagaaatgccattcggatctttttcagcttcacgccattgattgatggtaatgtcgctgaaaggagcagattctcctatattagtagcagcttcgttcatcaattccatatacttggcgtagttagataccgtttttatcagtttggtaggttgattcagtgaaaaagtagcattgtaagatacgctgacctttcctgtttgtccggttttggtagtaaccagaataaccccatttgcccctcggttaccataaatagcacacgaggccgcatctttcaggatggaaatagaagcaatatcgttgggatctacattattcagactttgttccatcccatccaccaacacgagtggtgaagagctgttcagggtacctactccccgaatattgaaagaaaagccttcattatatggagtcccggagctttgcatcacctgcaaaccggctgtcataccgctcaacgcctgcgaagcactgaccaaaggacgggaaagtgattccttttccaaatttaccgtagcaaccgaaccggtcaggttcaccttcttttgcgtaccataaccaaccactactacttctgaaagcattttcacattctctcccattacaatgttgaatgtcgtcttgccgggcgacaatgaaatttcctgcgtgtcaaaaccgatataagacacttgcaatttcttagcgtcctccggtatttccaattcaaatttcccttccatattactcaccgtgccaatattagtaccgggaattgataccgatactccaattaacaattcatcattgacatcgctgatgacaccattgatacgccgtttcttatccgatttctgaacgacaggccgggtgataataatatgattatcttttattttataaattaattcctgccctttcagaatctgatccagtgccttgcttatcggttgattatctaccttcacggttactttacgggtcaggtccacatcatttttctcatatactaaggatacatttcctttgacctccaactcccggaacgctttgcgcaccgttacgtcctgcaaatgtaaggtcacctgctgtgcgtgaaccgacagtggaagaactgcggctaatagcacgaagaacatgcatttgatgattttactcattgatttaagtttttatatgtatatcttttgttactaactcattgtcttacaatgttcttatttaaacattatccaggattgcgaactagcttcattatccgcatttttcacattgccattcgtttcccaatcgtatctgccggcaactttccctaaaggtatccctctattatcatcccgaatgacaacaggactatggtagttctcaccaaacacaatggcatccgtacaacccacttcctgcaatgccacagcaacttcccgtaaagaagagccatcactaaagacattccaagccgcttttaccgagttataagaatttgtaaaacgattacttatgaaaatgaccaagtctccttcttccgtgataccgacagcccgacgtcctacaggtttaccatcaaaagtccagatgcttaccggattagcagcccatgaattacttcctgacaatgctccatccattcctctgttacgggtcgaagtatttcttccttcattagtagcaaatgtcttgtaaagttctgcattttctccggcaatcatgatctgccctttttgcaacggataggaatatccactgacagcactggttggggaccactgtaccccattggcagcttgtttgccggctccgccgctggtaaacttatacaagttattatctatcacttctgcatacgaaatctccgcttttccatcagctgtaattcccagagttcccggacaatacttcaaagaagtagataggttatatccgagacgcggtgcggatagcagcccactatcattccacccgaggctataaaatatcggtacccagaattgcccggacaatcccggaacaaacaatgaataatccatattatcattcatgatagctgttgtacgatgttgagcagtgggttcagcccatgttacattgtctttattcatatcccagctaaccttcatatttattctaccggcaggaatagttatcaaccatcccgtattaccgctccttccatgcaagtttttattttcatagacaatcatgaaatcaggaatacgaatactactgtgttgactctttaaatcagcagtaatatttttccagtttacccctgcgtcaataattccatttacagcactcaactgatattttttagtcatgttgttcgtattgtcttttacagtaatagtaagtgtgctacttaggtcgacaatcaggtttccgttttcatccttttgactgacgggatccgtggagatgatttctgcgttatctgccaaggtcggcatcaacactacgtttgcaaatgcagtgttttgtttgaaacgtaacgaagcgatgccattaataaagttagcactaacctgctctgtgttacaagtagccgttacgcctcgaagtagctgagtagaagtgctgaaaatggtatattcgatatcatctgctccatcattcactttaatacgggtgataccgctgctcaagtccagtacagcatcagtagtgagcggatcaatgggctttgcccattcatccgccagtttgagtttcacattcaccgcactttggtcgtccaaaatgcgaaaatctaaggctatgaccctactgttctggtcaataagaccatttatccagttccctgtgccatcttctgcctgtatggctaccaatggttcttttacgtaccccggattttcggataagacaacacctttcagttcatcttctccgcatgacgtgaatataaacacaaggaatgtgcttaatagaaaatgtagtttcttcatacaatattatttaaataagaaatagcttattttctgttattcctgaaaacaatctttatcctgcatgactaaactaaaacagctgtttgtataccttataacttaaaaaagagtgtcgcgctatgctcttttacaatccttctttttaccattcatagagattcaggttaaaatatgctttattggcctattcattaatatgacagccagattaataaaaagtatagtgagaaatgatttttttattcgttcagcccttcaactcatctttttattagtgagtttggtcatcttacattttttcaataccttgcccccgaattatccatcggagaaacagaacctgtgagtattcaccttaatatattaactaataaatcaaatatacgatttctgaaagacataatggaaaaaaacctggaaacagagattatcgaggccctgaaatcgggtaaagaggaggcattccgatacatctataaaacttactatacagatctttgccggatagcgagagggtatttgacagactcttatctatcagaatctatagtagaagatttggtgtatagtctatgggaaaaccgctctaaaataacaattaacacctcattgaagaactaccttttcagaagtgtagccaataagtgtatcaattatcttcagcttgaatatgtgaaaagggaaacggcctgctcgtcagaagacctggtcatttacagcgatttatggtccttgggcgaaaatccggttgagcatttagagggtaaagagctacattctattatccagaagacgattgacggcttatctccggaaacccggaaggtatttttattaagccgttttgagaacaaaagacaagaagaaattgccgagatcatgggaatcactattcatacagtgaaatatcacatgcgaagtgcactggataaactgaaggaagcagcaagatcttatcttgccctgattgtaatgtttattacgaatatatttaattaatattaaaaagcaaagtaattcactatacttcttctattgacaaactgtcctgatgatagcgcaggtatatgattttcaatagatattaagtttaagatggtatgaaagaagaatttgacagactgatatatgatttcctctcgggaagtatcaccaaagaggacttgcataagttgaacgaatggatatactccgatccggagaatcagaaatattttgaacagcagaaacgaatctggcttctgtctgccgagtataaaaatgtatctgtacacgaagaacaagcctataacagatttgcgaaacgaatccgcaaacataagagtgctccggcaggaaagatgagaagagccttatttgtgaagtatgcaggttacgcagcggcaatcattatattactgtttaccactccttttataatttataattttacaacacctgatgattctttgatttccgaagtatacgctccaagaaaatcgaaattaaaaatgaagcttcctgacggttctatagtgtggttaaacgcagattccaagctttcttactccgagagttttagtcgaaagaatcgcaatgtccggctggaaggcgaagggtattttgaggtagagcatggagagcatccatttgttatacaaacagactccgcacagatcaaggtactgggtactaagtttaacgttaaaaattatggtgatgagaattatataaaggtatcactcctagaaggttccattgtcttattgtgcatcaaccaagagtttataatgaagcctaatcaaacgatgacagttaataagcttgaccaaacttataagctgaccgagagtgctgactatgctgaacagtggatcaactgcaaagtattctgggatgaagttcctatgtcgatcatttctaaagagttggagcgccagtttgatgtgacatttgcatttgagtcagagcaactcaagaatttgattttctatggaagttttattatagaaacaaataatttggagaaaatattggatattatgtctgaaacaaataaatttagctactcaattgaaaaagataaggtatatatccattcattgaaaaaataagaaacgattaaagaatcttcaaaaataatatcatgaccgcacaagagttttttaagaacgatctgtttgccgaaaatgcaggagtagtactgctggaagtacgcaaaggttacagtaaagccaaattagaaataaaacccgaacatcttaacgcaggtgcccgcacacaaggaggagcgatcttcacattagcagatctggcgcttgccgcagctgccaactcgcacggtacactagctttctctctctcgtccactattactttcctacgtgccagcggccccggagatactctctttgccgaagcacgcgaacgctatatcggccgaagtacaggttgctatcaggtagatataacaaaccaagacggagagttgattgcaacttttgaatctagcgtattccgaaaggatcagaaagtgcctttcgaagttcaggaataaaacaggaaagcgcatcaacacttttaaaagtataccttttagaaacagataacgcggatgatacggataaaaagataataaatccgtgtcatccgcgttatccgcgtctaaaaaataacaggttggcagggccatttacttctgatatgccttcgttttttctctatatctatttaacgatagaagtcagcggatgccggttacccgtcacattattcaggaatgcttttgccgaaccgaagttcaggaataaatccagacggacaggaagatggttcaagtcgtccgtcacgaagaaagtaatcacctccttttcttttcctttcttatcatattctaccaatgagaagatcaggcaacggtaagtaactccattctccgctttcacattttcttttccacggtagataagcgtttgctcttccactttacggcccgtagccatcgggaacttgattttgtctcccaccttataatctgcagggtcgtaagaacgtgcctgcgccaagatgcttaacatatcgtatatacaacggctatcgctagcttcagattcatcaaacgctccatcccgataagtacgtttctggtttacgaggcaaagaccgtccttataagaaaaccaagcctcatcaaccgtgtaacgttttccctcttcagcacctttgcggaaatagcgcggttccagtttttcaccgatcacacaagtcagcgtatcgcgcatcttgaaaaagaagtctgcccgtttactgcccaaagcaagcagattgatccggtaggcaggttgtgaatgataagtagtagcattcgtcgtcagactggcaagtccggctttcacccagacaaacttccagttgaagtataaatcatacattacatgttcgccggattgaaacgcatcattcttcgcttcacattgggcactggcagggagggcgaagattcccgtcagtaatgccaccaatccaataataaggttacatcgagcgtcaacgacggcggttctgattatttcgatccctatctttctttttcttgtcttcatctggtttttgttttttaagttcgtccggtttctgcttatccactggagtcgcatgaatatcccacggttgggtcacatcccacaacgctttatattccaatatcgtcggatagtagtaaacagcctccggctggatgcctttagcaaagtctcccgtgtcccattcaccatttccatttgtgtcattgattagtcgggctgcatattttcccggattcaggaagtagaaatcgaccattccgtcctcttccactctccgcttacggaccaccttgtcctgggcgtcaagtaattcgacaaaggccagtgagtctgctcccgtcacattgaaatgaagtgtgaaatattcatcttcactacgcaccttgaatccttgttttatcttatcggtaaataatccgtatattccgtggaaggcagtcgagtctaccgagaattcatattccaatgtcggttcccagtcataatacagattaaatttcttcagattcactgaatcctgctcaaactcgaatggtatatctttccagagcgtatctactttttgccgcagatgtatggcagcagtgtcataactggctatcggttcttcaaaattcaaagaaatatagccgtatacatccattgacgaaggggcactaacattcaccggcaagaatttcgtcggttcgggttcatcctcttcccctttctttttcttctttttctttttgtccttatccggctcctctttcttatatttctgcttcgaaacaaggttcagcgtatccgtacggggcactagctgattcaaagtatctgtataaagataagtcagactcatggccagcgtatcctgcttgaagagcagagaatctttcacccaataatggatcgtatcgttccgctgattcttttcgatgacaaaagcatccttttcatcgaagttcaaacctttcaagacaggcaaagtgtccgccttaccggcaaaatagaaagtgaacttttgaggaaccagtctttccgacttgataagatattgcgaatagttgagctctttaaaagcacggagaatgacatcatccggcaaataatgcatatatttcttctcaacaatcgtgtcgtaagtcaatgagtccacccaagccgtatccatgcggatgcgttcttccatgcgggggataatcaatgaatcgtggaaagcgatcatctcactcttctggttgaaggtaaaattctggtcggcatccatcaatccatagatgcgatatttgccgggagctacgccacggatggagaaacgtccacggctgtccgtacgtgccacacggtcgaaaggcaatttgttaaaagccgaatcgttcaggttggaatgtagtccgacaagcatacctttaataggctccaggttagaggcatcgagcatcgttcctgctacttccatcgtatcgatttccgtaccggtagagaacgtaaatgcaaagttacccaacggattaccttcattattgtcgacaatcgcatccgagaagtcaatcgtgtaggtcgtgttaggtttcagagagtcaagcaggttgacttgtattctcttgccggaagccttgatttccggttgctgtatctggggaggggaaacaacgactttctcggtcgctttctccagcttaataaactcgtcgaacatcaaagagactttagtccttttattattcaaagcccccgcctccggagtactgccgatgaaacggggcggcgtctcatcgtatggtccaccgtccggccgtccaatactggcgcaggaatataacatcgcccctagcgttactaccggaagcaccttgcgaactatttgctttatcttttgattctcaaattgtaacatgctgcaaaaataagcgttcttattcaataaacaccacactttctagctaatttattaaaaaaggaaagggtgacttaaggtaataaacaatatttgcgacgtttttatttctttcctgctaatataattagttttattgcctaaagagattacctttgttgcctaatcttttttcgttccactatagtgttccgcaaagaacactatagtttcccttgcggagcactatagtgggacgaaagagaaactatagtggaacgaaataaaagtagcaagtgaagtaaatccggataggcaaacggatttatcaatgtgcctacactaaataaaaacgaatatgagtatacaatatgacctttacgacacacctgacattcaacaaacaggcgacgcacaaccgcttcatccccgcgtagtattcaaaggaaccgtcgatcaggaagaatttctagaccgtgtacacaaattcacaggaataagccgcagtttactggcgggcgccatgcagtctttccaaaacgagttgagagacctgattgccaacggatggattgtggaactgggagatatcggatatttttcagtgtctttgaagggacctcgtgtaatgaagaaaaaagatgtacacgcacaatccatagaactgaaaaatgtcaatttccgggtaagtagccagtttaagaaagaagtaggccagcaaatgagactggaacgtggagaatcgatgactcgtcaccacagaaaagggcacagcgaagaagaatgtttgacaataatcaaccagcatctgaacaaatatccctgcctgacccgcaccgactatagccgattgacaggacacgacaaaaaacgtgctttgaaagaactgaatgcttttatcgaacgtggactcttaatccgttatggaacaggcaaacaggtggtttatgcaaagaaaacagaaagttaagttaaaatcatctagcagaattacctagaattccaattctgaactgaacaaaaaaaacaataattcagtgtagggttctttttatattaatcatatttatactgacttttagtaaatcagaactatctatgaaattataaaacaagattacttgctttatcaatatttattgctacttttgtagcggtttcctttcatacgtagagaggaacattttatttttttatagagaacgattatttattgcattcaaccataaattcggcaaaaatttaccgcgaatggcaataagtgatgtcaggtctcgcgcacacttctgtatataatttgtttatatacccaatgggcgtgggactatcacttatgtcgcggagggtctttgccgagcctatggttggcgtacagttgatagtttcccacgctctcttttttaaaccgcgcaccacagggaaatgatgcgacaaacataacaaagatatgtacgatgacctgaaagaaaacattattctagtaatgcagcaccctatcgcgcgccgccccatctccaacttatcagatgaagaacgagaaaaagcatttgacttgttgaactatctttcaactttatccgttgacgaaaactataccttgttagattacatccaaatggcacgtcttgaatatgcacttggagagcttgagtataagacaaccaatgatacagaaaaagtaatacgacattttagaaccgccctccaacatctggagaaaggagggttcgacttaagtataagcaagtggacagagttagtcagcctgcgaaccaaagaagacacggaataattcagaatcataacccttaccagtatatatagaagatagaaaacaaagcgaaaaagattgcttgtgcaagtagtcctttcgttctatcttcgaagaggatgccttccccacacttgataccccaatatcttgatcggcatcctcttcttctatctttctgccaaatcttttttacataaaattccccaatacagcagtattctacttattaactaatttattaacgcacaattctttttcagcttggtcatgaatttcggaaaccatatctttgcgtcgtgatcacaaaacaacaataaaacagattaactaactattaaaagaagaaagactatggcattaaagtatgttgtcaagaaaagagttttcggctttgacaaaacaaagactgaaaagtatgtagcacagaatgtaattaccaatacggtaaatttcagagatttatgcaaggaagtatccatgttcggtatgattcccgaaggcgcagtgaaacacgtgattgacgcactgattgatgcgttgaacacgaacctcaacaaaggattgtctgtgcaattaggtgacttcggatgtttccgtccgggcatgagttgcaaaagccagaaagaggaaaaagatgtagatgccgataccgttcgtcgagtgaaaattgtatttacgccgggatataaatttaaggatatgctggataatgtaagtatttacaagacggaaggaaacggcggcacctcttccggaaatggagggggaaataaaccggaaaatccggacgaaggcggtagcggtgaggctccggatcctgcagcataacgtatgaatcatatctatatatgtattagttatacgcaagtctacgtataaacagcgtataagaactgactaatataacagccaatttttattaacgtgagataccttttccaccgcggtggaaaactgtatctcacgtttttactgattagagtaagtaaaatactctattttctagctaatttattaaaaactagccttaattgaatgattttttgaccttcactgaataaaatattccctatctttgactcccgaaattcaaacctaatacaaaaaacccatgaagaaacaactactctcttgctgcttggctgcattgggactgacagcaattcaagcgcaaagcttcaacgagtggaaagatccggaagtgaattccgcaaaccgctccgctatgcacactaattactttgctttcgcatcggctgatgaagctaaagccggcattaaagaaaattccgcaaatttcatgaccctgaacggtctttggaaattcaactgggtgagacacgcagacgcacgcccgaccgacttttaccagactaatttcaacgacaaaggttgggatgatcttcaagttcccggtgtttgggagttgaacggctatggtgaccctatctatgtcaacgtaggatatgcctggagaagccaattcaaaaacaaccctccgctagtgccgacagaaaacaaccacgtaggctcttaccgcaaagaaatcatccttcctgctgactggaaaggcaaagagatttttgcacatttcggctcggtaacttccaacatgtacctttgggtgaacggacgttacgtaggatatagcgaggacagcaaactggaagccgagttcaacctgaccaactacctgaaaccgggtaaaaacgtgattgctttccaggtattccgctggtgcgacggcagttatctggaagatcaggacttcttccgctactctggcgtaggacgtgactgctatctttacgcacgtgacaagaaatacatccaggatattcgcctcactccagatttggatagccaatataaagacggtacgctgaacatagccgttgatctgaaaggaagcggcacagttgccttggacttgacagatactcaaggtaacagtgtagcaactgccgacctgaaaggctctggcaaattaaacactaccctatccatctccaacccggccaaatggactgccgaaacgcctaatctctacacgctgaccgctacactgaaaaacggcaacaacgtagtagaagtaatccccgttaaagtaggattccgcaagattgagctgaaaggcggacagatactcgtcaacgggcaaccggtactcttcaaaggagccgaccgtcacgaaatggacccggacggcggttatgtcgtttctctcgaacgtatgttgcaggatatcaaagtgatgaaagaattgaatatcaacgctgtacgtacttgtcattatccggacgacaaccgttggtatgacctttgtgaccaatatggtctgtatgtagtggccgaagccaacgtagaatctcacggaatgggttacggcgatcagacactggcaaagaacccgagttacgctaaagctcacatggagcgtaaccaacgcaatgtacaacgcggatacaaccatccgtccatcatcttctggtcactgggcaacgaagccggcatgggaccgaactttgagaaatgctacacttggattaagaacgaagacaagacacgtgccgtacagtatgagcaagcaggaaccagcgaattcaccgatattttctgcccgatgtattatgactacgacgcttgtatcaaatatagcgaaggcgacatccaaaagccgttaatccaatgcgaatacgcgcacgcaatgggtaattcacagggaggattcaaagaatactgggacatcatccgcaaatatccgaaatatcagggtggatttatctgggactttgtagaccagtcttgccactggaaaaacaaagacggagtaaatatctatggttatggcggtgatttcaacaaatacgacgcttcggacaacaacttcaacgacaacggtttaatcagccccgaccgcgtgcctaatccgcatgcttatgaagttgcttatttctatcaggatatatggactactcctgcggatcttgccaaaggtgagatcaatattttcaacgaatatttcttccgcgacctctctgcatattatatggaatggcaattactggcaaacggggaagtagtgcaaacaggcattgtatccgacctgaaagttgcaccccagcaaactgtgaaagtgcaaattccgtttgacgtgaagaatatctgtccttgcaaggaattgttgctgaatgtgagctataaactgaaagccgccgaaacattgctgccggcaggaacgactatcgcttacgaccagttaagcatccgcgactacaaagcaccggaactgaaactggaaaatcaacaggcttccaacgttccggttatcgtgcccagtattttggataacgacggcaattacctgattgtgaaaggtgaaaacttctctatggacttcaataagcacaatggttacctttgtcgctacgacgtcaatggtatgcaaatgatggaagacggcagcgcattgactcctaacttctggcgtgcaccgaccgacaatgatttcggagccggactgcaacataaatatgctgcatggaagaatccggagctgaaactgacttctctgaaacatgctatcgaaaacgatcaggcagtggttcgtgctgaatatgatatgaaatcgataggtggaacattgtcactgacttatactattaataataaaggtgcagtgaaggttacgcagaagatggtggcagacaagagcaagaaggtttctgaaatgttccgcttcggtatgcaaatgcgtatgcctgtcaacttcaatgaggtggagtactacggccgtggtccgggagaaaactatgctgaccgtaaccacggagccatgctaggcaaataccgccagacaatagaagaacaattctatccttacatccgcccgcaggaaaccggaaccaaaacggatatccgctggtggagacttctgaacattagtggtaacggattgcaattcatatcggatgctcctttctctgcttctgccctgaattataccatcgagtcattggatgacggtgacggtaaagatcaacgtcactcaccggaagtagaaaaggcagacttcaccaatttctgtatcgataaggcacaagcgggacttgcttgtgtgaacagttggggagccattccactggaaaaataccgtcttccttaccaagattatgagttaagttttattatgactcctgtatatcataaaataaagtaaaaaacatagttaaaaaacacggtatcagagaacaagaataccgaatttaaagtacttttgcagccggaaactaatttaaccgaattagtttccggctttttcttccttaacctccttaatctatatggacgaacagcacactggcaacaaatgcattaaattaaaaaacagatatttataagtatgaaaagtagaattgttttatttgcattttgcgtagccctcttgtcaagttgtggcaataagggcaatgacacaggaaaggttcctgaatatgcagtacaagagttacaaaagacgaccgctaatttaacaactgcctatccggctaccatcaaaggtaaacaagatgtagaaatccgcccccaagtatcaggcttcatcacaaaactctgtgtagacgaaggagcagctgtacgtaaaggacaagtgttgttcattgttgatccgactcaatacgaagcagctgtacgcactgccaaagcagcagtggctacagcagaagcagcagtgagcactcaacagatgacgtatgacaataagaaagagttgaacaaaaagcaaatcatcagtgactatgacctggcaatggcagaaaactccctggcacagaccaaagcccagctggcacaagcaaaagcacaactgaccactgctcaacagaacttgtcattcacacaggttaaaagtccgtcagatggcgttatcaacaatatcccttatcgtgtaggagcattggtaagcccttctatcgctacaccgatgactactgtttccgagattgacgaagtatatgtatacttctcaatgacagaaaaggaattgctggcaatgaccaagtccggtagcactatcaaagaagaaatcagcaaaataccgactatcaaactacaattaatcgatggttccacgtacgatatagagggtaaagtggatgctatcacaggcgttatcgaccaatctaccggttcggtaagcatccgtgccatcttcccgaataaggaacatgtattgcgtagcggaggtactgcaaacgttctgattccttatgctatggagaatgtaatcactataccgcagtctgcaacagtagaaatccaggataagaagttcgtttatgttctgcaaccggacaacacggtaaaatatacagaaatcaaaatcttcaatctggataacggaaaagactacttggttacttccggtctgaattcaggagataaaatcgtaatcgaaggagtacaaaacctgaaagatggccagaaggttcagcctatcacaccggcgcaaaaagaagcaaactatcaacaacatttgaaagaccaacacgacggtaatttagccacagccttcaactaataatcagataatcattatgaaattagatagatttattaaccgtccggtactatcaaccgttatttctatcctgatagtcatcctgggggctatcggattggcgacactgcctatcacgcagtatccggacatcgcgcctcctaccgtttcggtaagagccacctatacgggagccagtgcatcgaccgtattgaattccgtgattgctccgttggaggaacaaatcaacggtgtagaaaacatgatgtatatgacctcaactgcgtcaaacacgggttccggtgatatatccatatatttcaaacaaggaacagatccggacatggccgccgtcaatgtacaaaaccgtgtctctatggcacaaggtctgctgcctgccgaagtaactaaagtcggtgtaaccactcaaaaacgccagacttccatgttggtagtattctctctttatgacgagacggatacctatagcgaatcgtttattgaaaactatgctaagatcaacctgattcctcaagttcaacgtgtacagggtgtaggtgatgccaacgttttaggtcaggattattctatgcgtatctggttacgaccggatgtcatggcacaatacaagctcgttcccggtgatgtttccgctgctctggcagaacagaatgtcgaagctgctccaggacagttcggtgaacgcagtgaccagactttccaatataccatccgttataaaggacgcttgcaacagcctgaagagtttgaaaatatcgttatcaaatctcttcctgacggtgaagtactccgtctgaaagatatagcagaaattcagctggaccgtttgggatataactttaccaaccgggtagacggtcacaaatctgtgacttgtatcgtataccagatggcaggaaccaatgcgacacaaaccatcagtgatattgaggcattgttggatgaagcatcaaaaacgttgcctaccggattgaaactgaacatctccatgaatgccaatgacttccttttcgcttctatccatgaagtggtgaagacgttgatcgaagcatttatcctggtgtttatcgtagtgtatatcttcttgcaggatttacgttccacattgattccgactatcgccattccggtagctctgatcggtactttcttcatcctgtccctggtaggattcagtctgaacttgttgacgttatgtgcgctcgtgcttgctattgcgattgtggtcgatgatgcgattgtggtcgtcgagggtgtgcatgccaagcttgaccaaggttatacatctgcccgtctggcttctatcgatgccatgaatgaattgggtggtgctatcgtatctattacgctggttatgatggccgtattcgttccggtaagtttcatgggaggtacagcaggaacattctatcgtcagttcggtatgactatggctatcgctatcggtctgtccgcattgaacgcattgactttgagtccggctttgtgcgccgttcttctgaaacctcacaaaaaagaagatggaacaacggaagactccacattgaaagaacgtatgaaagtagcctatacggcagcccatacaactatgatcaacagatataccgaagctatcggaaagatgttgcatccgggaattacacttactttgacgcttattgccattctcggcatgatctttggtttgttcagtatcaatccgatagtcactgcaattttcgtagtgcttagtattctggcactgatcggaatgagtacgaagaagtttaaaaacagattcaacgatacatacgaatcaatcctgaaacgttataagaaacgagtactgttctttatccagaagaaatggttgtctatgggattagttgtcgcttccattgcgatacttgtattcttcatgaacaccactccgacaggtatggtgcctaatgaagataccggaacgctgatgggagcagtgacattacctccgggtacttcccaagaccgttctgaaaaaatcctggcacgtgtagacagtctgatcgcttccgatcctgcggtattgtcacgtaccatgatttccggattcagctttatcggtggccagggaccatcatacggttctttcatcatcaaactgaaagactgggacgaacgttccatgatacagaattcagacgttgtagtcggttccttatatatgcgtgcacaaaagattatcaaagaagcacaggtattgttcttcgctcctcctatgatcccgggttactcggcatctacggatattgaggtcaatatgcaagataagaccggtggtgatctgaacaaattcttcgatgtggttaatgattatacggcagcattggaagcacgtccggaaattaattcagcaaagacttccttcaacccgaatttcccgcaatacatgattgacattgatgcggcagcttgtaaaaaagctggcatcagcccgagcgatatcctcactactatgcaaggatattacggaggtttgtacgcatccaacttcaatcgtttcggtaagatgtatcgtgttatgattcagtcagatccgttatcacgcaaaaacctggaatctttaaaaaatatcaaggtgcgtaatagtgcaggcgagatggccccgattgcccagttcatttctgtggagaaagtatatggtccggatattattagtcgtttcaacctttatacctctatgaaagtaatggtagctccggcaagtggttatacatccggtcaggcattgacggctcttgccgaagttgctcaagaaaacctgcctaccggttatacgtatgaactaggaggtatggcgcgtgaagaggctcaaagtagcggaagtgctaccggactgatttttgtactctgttttgtattcgtttacttattgttgagtgcacagtacgaaagttacattcttccattggccgtattattatccattccgttcggtctattaggcagtttcctgtttgtgaatggtgtaagtgctatcggtaatatttcggcattgaagatgattctgggtacgatgtcaaacaatatctatatgcagatcgcgttaatcatgttgatgggtctgttggcgaagaatgccatcttgatcgtagagttcgccctagatcgtcgcaagatgggtatgagtatcacttgggcagctgtattgggtgccggtgctcgtctccgcccgattctgatgacatcattggcgatggtagtcggtttgcttccgttgatgtttgccttcggtgtaggtgcccacggtaaccgtacactaggtactgcctctatcggtggtatgttaatcggtatgatttgccaaattttcatcgttcctgccttgtttgttatcttccagtatctgcaagagaaagttaaaccgatggaatgggaagatattgacaatgcagatgccgtaacagagattgaacaatacgctaaataatgaaattcgatatgaagaaacagattctatatatgttgtgcgcaactgctctcttgagcagctgccacatctataagtcgtatgacagacccgaagatatcactacttccggcctgtatcgcgatccggtagcggataatgatacactggtttcggatacagccaacttcggtaatctgccgtggagagaagtcttcaccgacccgcaactccagtcactcatcgaaacgggactgaaacaaaatactgacctgcagagtgcaatactatcaatcaaagcagcccaggctccgttgttggcagccaaactagcctatgttccagctctggccttgtccccacaaggtactatcagcagttttgataatagtaaagcaagtaagacttattcacttccggtaaccgccagttgggagattagtctctttggaggcttgctaaatgccaaacgaggtgcagatgttgccgttaagcaggccaaagcttacaaacaagctgtacaaacgcagattattgccaatgttgctaatctgtattacactttattaatgcttgaccgccaactggaaatcaccagagagacagcagaaatattaaagcgtaatgccgaaacaatggaagcaatgaaaaatgctgctatgtataatatcaattcggcaggtgtcgaacagagtaaagcggcttatgcacaagtgatggcctctattccggaaatagaacagagcatccgcgaagtggaaaattctctatcaactcttcttggagaagctccccgccatatccaacgcggtaccatcgaaaagcaaattctaccatccgaattttcagtaggcatacctatccaattattatccaaccgtccggatgtaaaagcggctgaaatgtcactagcttctgcttattataacacgaactccgcacgttccgctttctatccacaaattacacttagtggatctgccggatggacaaacagcgcaggctctgctatcattaatccgggaaaattcctggctactgccatcggctcactgacacagcctctcttttatcacggagcaaatatcgctaaactgaaaatggccaaagcgcaggaagaacaggcgaaactctccttccagcaaacgctgttgaatgccggtagtgaagtcagcaatgcgctaagtttataccaaaagacgagtgaaaaggtagaatctcgtcaaatgcaagtagaatctgccaaaaaagcttcggaagatacaaaagaattgtttaacttagggacttcaacctacctggaagtattgtctgcacagcaggcttacttgagcgcacaaatctcacaggtttccgattgctttgatcggatgcaggctgtagtaagcctttaccaggcactgggtggtggaagagaagaataactttaaacatatactattatgattagtccgttagcttacgtagatcccgaagcaaagctgggcaagaatgtaaccgttctgccttttgcctacattgaaaagaatgtagagatcggggatgactgcgtcatcatgtcttacgctagtatcctgcaaggtactaaaatgggaaaaggaaacaaggtacatcagaatgctgtcctcggagcggaaccacaagatttccactatactggagaagaaagcagcctgattatcggagataataacgatattcgtgagaatgtagtaatcagccgcgctacatttgccggcaatgctaccaaaatcggaaacggaaactacctgatggataaagtacatctttgccatgacgtacaaatcaacaataactgtgtggtaggtatcggcaccactattgcaggagaatgtacgttggatgattgcgctatcctaagtggaaatgtcactttacatcaatattgtcacatcggaagctggacactggtacaaagcggctgccgtatatctaaagatgtacctccatacgttatcatgtcaggaaatccggtaacatatcatggtgtaaacgctgtagttctttctcaacatcacaatacatcggaaagaatccttcgtcacatcgctaacgcataccgtttgatttatcagggtaatttcagcgttcaggatgccgtacagaagattatcgaccaggttcctatgagtgaagaaatcgagaatattgtaaatttcgtgaagaactcggaaagagggattgtgaaataaacaatataacatctataaaaagaaagggtgatgctcaaaaaaagcgtcacccttcttttttatagatggatgacgcaatagataatatttttacaaatggaggatacttcagtgattcagcaacactagtgattcatcttcaaatccagaaattcaattcatcattcaaattccaaagtaccgaaaaaatcggggcgatggaaatccggttggtcaatctctatcggattccatgaaagaaaatgaggagtctgcaactcatcaccacacttatagaaattagcttttatctcctttccatcgagtgattcaatctgatgcttaaagaatacagcatacggaatgatgagagcaacttcccagtctgtctcctcgacacgttctgcaaaaggctgattacccagactagaccaacgttgtacgagagcagtcacttctttcggtgcatgttcccggttgttacgaactgggccggcacctatcaggatagttccgatgcaattacattctatattataatagatcccgtcgcctgcaggtatagaaaagaattccacacaagagtcagtccatacagaaccgttatcttctccatacttggcacgtacactctcctctttcactttaaaatgtagcaagattgagttctgcgtgtgagcaattcgaaaactcactttaggtttgtaaggatattcagcccaattgacacactggatcggctgaaaatctattttttcttcatcgaatagtttaggaagcgaacaagcctccacgttagccgcactaattttctttactttcatatatctttcgtttgaatgatacaaatatagttactttcttctaataaggttcactgaaatcgaataaaaacaatatatttgcatagatgtaaacaccttaaaaaataaattagtgagaaaagtaattcttttatttctgctatttttaagcgtagctggagtccgcacacaaggtcaaaacatcacttttagccacttgaccacggacgacggactctcccaattttctgtcaatagcctttatattgatgaacggggaattatatggatcggcacgcgtgaaggactgaaccggtataacggtaacgatatcaaaagtttcaaacttaataaaaacgatccgaacagcttgttcagcaatacagtgctgcgcatcaccggaaacaaaaacggaaaggtatacctgctctgtacggacggggtggcagaattcgatctgaccacacaaagattcaaaacgttgctgcaaggcaatgtggatgctatttatttcaacgagaaattatatatcgggaaaagagaagaagtatttgtatataatgaaagtacgggaaacttcgatctctactatcatcttgccggaaaagatatcaccctctcctgcctccacctggacgaaaagaaaaatctgtggatgggaactaccagtaacggactttactgtttatcgggagacaaaaagatttcccaacctgtcacaagaggtaatatcgcgagtatttacgaagattcgtctaaagaattatggatctgtacctgggaagaaggactctaccggataaaaacagacagtaccattgagaacttccgtcatgatcccaaaaatccaaacagtatttgcgccgacttcgtaaggagttgctgtgaagataatgcaggaaatctatggataggaacctttcacggattaaatcgctatgaaaaaagcacaggtaaattccaactttacactgccaacgcgaacaaacccgacggactcacccactcctccatctggtgcatcgtcaaagatgaacaaggaacaatttggctgggtacttatttcggaggtgtcaactatttcaatccggaatatgaaatctatacacgctacaagacaggagatacagaaaaagaaggtttaagtagcccgattgtcggcagaatgactgaagataaagacggaaacttatggatttgtactgaaggcggtggcgtgaatgtgtacgaccggaaaaataacacctatcggtggtatcgccacgaagagggcaaaaatagtatttcccataacaacgtcaaagcaatctattacgaccggactaatgaaattatgtggataggtacacacttgggaggattgaacaaactcgacctgcgtaccaaccgtttcacagtctaccggatgaaagccggagacccaacctcactaccttcggatatcgtccgagacattgtaccttataaggacaagctggttgtcgccacacaaaacggtgtttgtcttttcaatccggcaacaggcacttgccaacaactcttcaaagagactaaagaaggaagaggtattggcatggtagccagtctttgcattgataaagacggtacattgtggattgcggctaccggagagggtgtttattcttaccggttcgacagcggtaaacttactaattatccgcacaatcccgctaatccaaacagtcttagcaacaataatatcaacagtatcatgcaggacagtaacggcaatctatggttctgcacctccggaagcggtctcgaccgttaccgtaaggcaagtgatgactttgaaaacttcgatgtacagacagatggtttatccagcgactgtatctacgaagtatgcgaatcgtccatacagaaaggtgacttattgctgattaccaatcaaggattctcacagtttgactatccaagcaagaaattctataattacggtacggaaaacggattcccgttgactgccgtcaatgaaaacgcactatttgtgacacatgacggagaagtattccttggcggtattcagggaatgatttctttctgggagaagaagttacatttcactcccaaatcatataatatcattctttcccgcctgcttgtcaacggaaaagaagtagttccgggagatgaaagcggcatcctggaacagtcgatctgccacactccggaaatcagtctgaaagcgaatcaatcgatgtttagcatcgaatatgccacttccaacttcatccctgccaacagagatgaaattctctatcgcctggagggtttctcagacgaatggaaccatacttaccggaagcaaacgctgattacttatacaaacctgaatccgggtaaatatacccttgtcatcaaatcacagagggaaggaataaaagaggccagactgctgattatcgtactcccttcatggtatgagacatggtgggcttacctgatttataccattgtcactatcagcctgttatggtatcttattcagaactataattcgcgcatcaaactccgtgagtctttgaagtacgaaaagaagcatattgaagacctcgaagcattgaaccagtcgaaactccgtttcttcactaacatctcgcacgaattccgcacaccgttaacgctgatcgtgggacaagtggaaactttgttgcaggtgcagacatttacgcctaatatatataataaggtgttgggaatctacaagaacagtctccaattacgggaactgattacggaactacttgatttccgtaaacaggaacagggtcacatgaagatcaaagttagccagcacaatctggttaacttcctgtatgagaattatctgctcttcctcgaatatgcgagcagtaaacaaatcaacttcaagttcaacaaacagaaggatgacattgaagtatggtatgaccaaaaacagatgcagaaagtgataaacaacctgctgtctaatgcagtgaagcataccaaggccgaagatacgatttcgattaatgtatcgcaggagaaagaccatgtcatcattgaaataaaagataccggtacaggtatcgccgctgccgaaattgataagatattcgaccgtttctaccagaccgaacatctcaactcgctgaataccggagccggtacaggcatcggactggcactgacgaaaggaattgtggaacttcatcacggcacaatccgggtagaaagcgaaccgggcaaaggaagcagtttcattatcaccctcaaactaggcaaggaacacttcacagaagagcaaatagcgaaagatgatacggaaaccatccagcaaacagagactattgttccttcagtagaaataatccctgattcggaatggaaagaagaagataacaagcgcatcgaagacgccaaaatgctgatagtggaagacaatgaatctatcaagcagatgttagtcggtattttcgaaacattctatcaagtcagtacggcttccgacggagtagaagcattagaaatgatacagaaggatatgccgagcatcattttaagtgatgtcgtaatgccacgcatgtcgggtacggaactttgcaaacagatcaagacggactttaacacttgccatattccggtggtattattaactgcacgtactgctatagagcacaatatcgaaggtttgaagattggtgcggatgattatatcacgaaaccgtttaataccaatcttctgatttcccgctgcaataacctggttaactcccgccggctattgcaagagaagttcagcaaacaaccacaggcttttgcccaaatgttggctaccaacccgatggataaggagatgctcgaccgcgcgatggccattatcgaacgccatctggacaatacggatttcaacgttaatatcttcgcccgcgaaatgggtatggcacgtacgaacctattcactaaactgaaagcagttacaggccagaccccgaatgatttcatcctaagcatacgtctcaaaaaaggcgctgtcatgttaaggaataacccggagctgaatatcacggagatctctgaccggattgggttctcctcctcccgctatttcagtaaatgtttcaaggagatttatcacgtcagtccgctggcttatcgtaaaggagaagagagcgaagaagaaggagacggagaagaaacagattagcaggtaactatacaagcactcttgcaaaataatcttatattattaggcacggatcacacggatttcacggattaaaaaacgatgagtatgaaaacaacagcgttaatccgtgtaatccgtgcctaaatttatgatataaacggtttcttagtccggacatcttcgcccgaataaagaaggtaacttcttaagtgtactattttgtacttcacttgtacattcctactcattctttttcttccaatcgcttatctttgtgttcattacattatttcctaaaacattcagcattatgaaaaacgtttcgcgtctacttcccctattgtccggcatcgtcacgctgtcaggatgcagtcatgcaccccaaaagagcaatgggcagaataaccaaaagcctaacattatttatatatttgcagatgatctcggcattggtgatttaagctgttatggagcaacgaaagtgagtactcccaacatcgaccggttggcaggacaaggagtacaattcaccaatgcttatgcaacttctgccaccagcactccttcccgtttcggactcctgacaggtatgtacccctggagacaagaaaacacaggaatcgctcccggcaactctgaactcattatcgacactacctgcgtcaccatggcagatatgctgaaagatgcaggatacgcaaccggtgcagtaggcaaatggcatctgggactcggtccgaaaggtggaaccgactttaacaaccggattacccctaatgcacaaagcatcggttttgactacgaatttattattccggctaccgtagaccgtgtaccttgtgtatttgtagaaaacggacatgtcgtaggacttgaccccaatgatcctatcaccgtaagttacgaccacaaagtcggcgactggcctacgggagaagagaacccggagctcgtcactttaaaacccagccagggacacaacaatacaattatcaacggcattccccgtatcggctggatgaccggaggaaaatccgccctttggaaagatgaagacatagccgatatcatcacccataaggctaagaatttcattgcatcccatcaggaagaacccttcttcttatatatgggtacgcaagacgtacatgtaccgcgcatcccccacccacgtttcgcaggcaaaagcggactcggcactcgtggcgacgtcatcctgcaactggactggactatcggtgaaatcatgcacacactggacagcctccacatcgcagacaacactatcctgatctttaccagcgataacggtcctgttatcgacgacggctatcaagaccaagcttacgaacttctcaacggacatactccgatgggtatctaccgtggtgggaaatacagtgcttacgaagcgggtacacgcgttccatttattgtccgttggcctgcccgggtgaagccgaacaagcaacaagctcttttctctcaaatagatgtgtatgcatcgctcgcctcacttttggaccaacctttacgcaaaggagctgcccccgacagtcaggaacatctgaacgttctcctcggcaaaaataatacaaaccgtgagtatgtcgttcaacagaatctcaataacacacttgccatcataaaaggtcaatggaaatacatcgaaccgagcgacggccccgccatcgaacattggacgaaaatggagttaggcaacgacaaacagcctcaactttacgatttatcctccgatccatcggagaaaacgaatgtatcaaaacaacatcccgacatagtgaaagagttatccgaattactagaatccataaaagagaaatagtttatgagaacagaaaaattgtatgattttgcaccaatcttgaataattctatccatattagaatattcaatccgtctatctttgcaagcgtagattcaataaaatcacttaatttttaatatatgaaaaaacatttatccactcaaactagaaaaaggatgctctcctccatcggactgatcttattttctgtttcttttgtacttgcacaggtacttgttaaaggtacagtgaaggacaacttaggagaaggagtgccgggagccagtgttcaggtacaaggtacttcacaaggaacaatcactgaccttgatggtaaatttgcttttaacgtacccaataagaattcaatattggttatttctttcattggttatgtcactgtagaaataaaggcggacactcaaaagccaatggttatcacattgaaggaagatacaaagacattggacgaagtggtagtagtcggctatcaggaaatacgcaagagagacctgacgggttctgttgccaaagccagcatggcagaactgcttagcactccgactgcttctttcggcgagacattaggcggacgtattgccggtgtcaacgtaagttcgggcgaaggtatgccgggcggacagatgaacatcgtcatccgtggtaacaactctttgacacaggacaactctcctctttatgtcattgacggtttcccggtggaagatccttccatagccgcagccatcaatcagaacgatatcgagtcactcgatttcctgaaggatgcctctgctaccgctatctacggtgcccgtggtgccaacggtgtcgtgatgattacaaccaagaaaggcacaatcggtcagcctaaaattaaatatgacggaagtttcggtattcagcatatcaccaaaacgattccgatgatggatgcatacgagttcgtcaaactacaggcagaacgtagtcccaaagatatggaaactacctacttcatgaattatgacggtaagaaatggggactggaagattataggaatatcccgcaatataactggcaggatgaaatcttccgcagcgcatggatgcaaagccacaatgtcagcctgaccggtggttcggaaggagttcgctacaatgcttctttatcttattatgaccaggacggtatcttattggaatcaaactacaaacgtgtacaaggccgtatgggtactaccatccaaaagaagaaactgaaaatctatctgacaaccaactattcaagcactacaaccactggtggttctccttcccagaactcatacagtggtatgaataacctgttctatagtgtatggggatatcgccccgtgaccgaaccggacagaccattaaactcattgatggataacatcatggacgacgcgataaacaataccaacgattatcgtttcaatcctatcatgtccttgaaaaacgaatatcgcaagacgtatgcgaactacattcagttcaacggatttgcagaatatgaatttatcaaaggattgaagttgaaagtttcaggcggttacacattcgatacccgcaaaggggaaacattcaacaactcgaagacccgttatggtaatccgaaatcatccgataaggtaaatgcagaaatctaccattctcaacgtgcaacatggttgaatgaaaatattctgacctatcagagcaatatcaaacggaagcatttcttcaatagcatggtaggtgtaaccctgcagaattccgactatgaatactattcatacaaaacggtacagattccgaacgaagcactcggcatggcgggaatgagtgaaggaactcccagtacgactaaatcattaaagagttcctggtctatgctttctttcctgggacgtttgaactataactataaatcattgtattatgcaacggtttctttccgttccgacggttcttccaagttccgtggtgataaccgtttcggctacttcccttccggttcattggcatggggattcatggaggaagattttatgaaaccattgaagtctgttgtttcttcaggtaaattaagagcaagctggggattgaccggtaacaaccgtgtaggcgagtatgatacgtatgctttatatcagatattgaaggataaagtcggagactttatttcgatcggtagcctccccagtggtgtatatccgttcgaaaacagcctgacaagtgtaggtacagtgcccacttccttaagaaacagaaaactgaaatgggagactaccgaacagtggaacctaggcctggacttaggcttcctggacgaacgcatcggattaaccgtagactggtatcgtaaaacgactcgtgatttgttgctgaatactgcacttcccacctcttccggttatttcagtgccatgaagaatgtaggaaaggtacgcaaccaaggtatcgagctcacattgaacacaaccaatatcaagaaccgtcatttctcatggactactaactttaatatcgcattcaacaagaacaaagtattagaattggccgaaaaccaatcttctctgttgagtgcagccaaatttgaccagaactataactctcaatacagctacattgccaaagtgggttatccgatgggaatgatgtacggattcatctacgaaggtacatacaaatacgaagatttcgacaaagtaggtgatacatatacactgaaacgcaatgttccgtatttctcttccgaaagtaatacacaaccgggtatgccgaaatacgcagacctgaatggtgacggtatcatcgacgataacgaccgcactatgatcggtaacggtatgccgaaacatacgggcggatttaccaacaatttcgaatacaaaggatttgacttgagcatcttcttccaatggtcgtatggaaacgatgtattgaatgccaaccgcctgttcttcgagaacagcaataaaacacgtgacttgaaccaatacgcaagttacgcagaccgctggacaccggaaaatccggaaagtaatattccgagagctaccgactccggttctaacaaagtgttctctacacgtattatcgaagatggttcgttccttcgtctgaagaccgtgtctttaggatatacactgccgaaacaactgaccaagaaatggaagatagacaatgcacgcgtattcgttgccggtcagaatctatggacatgtacagggtattccggttacgacccggaagtatctatccgtgaaggcgcactgactccgggactggacttctccgcttatccgagagcctactctatcagttttggtataaacttaggtttctaatcaatcatccttcaaacaattacgtatatgaaaacaataaaaataatcatcatatcacttcttgtcggacttaacctgacttcctgcgatttcttggaaaaagacccgacatacaccactcctgaaaacttcttcaaaaatgaagcggacgctacctcttggctgacaggaacctatgccattctgggacaaagttccttctacggaaatgagttcttataccttgtaggaggtgacgatctgggacactatggtggtgccaaccgcggacctaacaaaagtgggttgatctgtaacaatgccaacacaagtgatccggccgttgcagcattgtggtacacattatactccggcatcaacagagccaatattttcctggaaaatattgatgcagtgcccgatatgaacgacgatacccgcaagcagtacaaagccgaagcccgtttcttacgcgcattctattattttactttggtagaatgttggggagatgtacctttcaagactacttctacagaagatgcctataacctctccattccacgtacggacaaacagacgatttatgattttatcatcaaagagatgtatggttctgccgaggatctcaaatctgctcaagatttgaactatttaccgggacgtgtttccaaatcggctgcttggggaatgttggcgcgtgtatatatgttccgggccggtgaacctaaacgtgacaaggaagtgggtttggctaacaacacgactagtgccgagattacagaatatttcaaaaaagcaagttactatgcacagttagtcaagaatgagggtcattcactaactgccaaatattgggacttctttatcgacatttgttctgataagtataacactgctctcaataaggatggtgccaaggctaatgaaagtatttgggaagtagaatttgcaggtaaccgttcgacggatgtacgtgcagaaggtagaatcggtaatattatcggcattcagggtaaggacctttcttccaaagcatccatcactggtaaaggtgatccgggctatgcatacgcttttatctggaatactcctaaactgctggaattgtatgaagcaaacgatgacattgaccgttgcaactggaatattgctccattcacttacacccagtcagcaggagaaggtactccggtggacggtcgtgaatttgtaaagggaaaaagagatgaagtggaacaacaatactgggataaatccttcagctatggtaaaacagagccggggtctacttacggtgatcgtgaatcgaagaacgatgccaataagaaccgcaacagggctgccgccaaatatcgtagagaatatgaagcagacaagaagagtaaaaacgatacttccatcaacttccctcttctccgttactctgacattctgctaatgattgcagaggcagaaaatgaagtcaaccatggccctaatgatttggcgtatgaatgtatcaatgcagtaagagaacgtgcaggaatcaaaaaacttgcagcaaatctggatgaagagagcttccgcaaagctatcaaagacgaacgtgcaatggaactctgtttcgagtacacacgccgtttcgacctgatccgttggggagactattacaaactgatgcaggaacaagtggacaaggcacaggctgacgaatcctggaaattcggaatcaatgtatatacttacttcaatattccgaagtcttacaattatttcccgattcctgccaatgaaataggatcaaacggtgctatcaagacgaataatccgggttggtaattctcttaataactttaaaaagaaaaggacatgaaaataatatataaaagtttgatgactatcgcttttgccggactatccctggcttcatgcgacaaggaattaaaagaagaaacagcaatggaagtgggtgtggtgacagacagcaatgtcagcttcgatggcaaaactgtgactgtaaagaaaggaaaccctgtaacgttcagcttcgatggtgaccctgattttatcagtttcttcagcggtgagatagggcacgaatacaaacaccggaacagaattgaaatgcaaccggaagacgtagaaaaatgtgaaatcaacttctccgtagtatatgactatggtagtgcgaaaaccatcgaaggttctactcacatattaatatccgatcaattcgaaggaattagtggcaacaatgtggaaaaagacaaagaagcagttactaattgcgaatggacagaacttgtcagccaagatgagcttcctaaagcaaccaaagatactaaagactattcttgtcctttaatatcttacttgggtaaagaaatcagcattgctttccgcctcaaccctcttgataatagcagcacaatgcctgtaatacatattaaaggcttacagcttaatctggagttcaacaatggaaaatcaaccacaattaatgcaaagaacttcgaattctcggctttaaatgtaacctacaatttagatgatctttcaaaaaacaacactcatcttaccaaattgaaggaagcattaggaaataaaaacctcacacttgaagagatgaaaagcgcagaatatgcagataaaatagcatatgctactgtagacggtaatattccttatttctggagaattagccagccaagcgatttcgtaaccagtggcggagcagcagggtatacaaaaggagatacttggcttatctccaattccatcctccttaacggttcctgcgatcctgacgctggtgtagctatcaagaatatctcgcaatcgttggagatatactcacatacctatgaagaggccggtacatataccgctactttcgtagccaacaatgcaaactacgtccatcaaggtggtcaagtagtacgtgaactgactataaacgttgtagaataaaaatatatcccccaatttttctaaccttcaatcatagaaaacgtttataaaaatcagactttaatcaatttaacatcagaaagagagggaccgcgaggttcctctcttttactttttctgtatctttgcacaaaaataaaaataatgccaaagactcttcctattcattttgccccattacaaggttacaccgaagtgttttaccgtaatgctcatgctgcctgcttcggaggtatagatacttattataccccatttgtacgactcgaaaaaggcggattccgccatagagatgtccgcggaatcgaacccgggaataatcaggtagcccatctgattccccaactgatagccccttcttttgagaaagcagaaaaaatcttatccctattcattgaaaagggatataaggaagtcgacatcaatataggatgtccttttcccatgctggctaaacgccacaatggttccggcattcttccttatcccgaagaagttcaggcgttacttagcctgattacagaatatccgcaaataagtttctccatcaaaatgaggttgggctgggaagatccggaagaatgtctgaaactggctccgattatcaatgagctacccttgcgacaagtggttatgcacccccgcttgggaaaacagcaatacaaaggagaagttgaccttaaagcgtttgaggcttttcagaatgcctgcaagcatccgctcatctataatggagatatcaatagtgtagaagatattcaccgcattcaggaacagtttcccggactagccggaatgatgataggacggggattacttgccaacccggcattagctttggagtatagacaaaaccgtgcactcgagttcgatgaaatgagagaaaaattgcaatctatgcacaaatgcgtatacaatcaatatgcagaacagttggaaggaggagacgaacaacttctgaacaaaatgaaaactttctgggaatatttaatgccgcaagcagacagaaaattactgaaagcaattcataaaagcacaagtctcaacaaatataatcaggcaatccttgccttttttaatcaacgatgaactgataaccagtaattttacgtaattttgcgcccgtttacaaacatgcacattatgaaaaaatacattctaatctttctttgtctgataaccgtatcaggcagtttcgcacaaatgcaggatttcaagttcaaattctatggacagattcgtactgacttctattataatagtcgtgctaacgaagaaaccgtagacggattgttttatatgtatccaaaagacaaagtgcgtgatccggaggggaacgatttgaactcaacacccaacagtaacttctatactttatattcgcgccttggagtagacgttgccggtccaaaactgggaacagccaagacatctgccaaagtagaagtcgacttccgcggcacaggcacttcttattcggtcattcgccttcgtcatgcttatttgaatctggattggggaaaatcagctttattactcggacagaactggcatcccttattcggagatgtgtctccgcagattcttaatctctccgtaggagcaccgtttcagcccttcagccgtgcgccacaaattcgttatcgctatacaaacaagaatttccaacttaccggagccgcagtgtggcaatcacaatatacttcacaaggaccggaagggaaaacacataagtatctgaagcaaagctgtattcccgaattttatgtcggagctgattataagaatggcggtttgctggccggcgtaggcattgagttgttatcattgaaaccacgtacggagtctatagtaaatacagataaatacaaggtagacgaacgcatcacaactctttcatacgaagctcatgtgaaatacaccaacaaagactggttcatcgctgcgaagagtgtattaggatccaatctgacacaagcttccggtttgggtggattcgggatcaagtctgtcaacgaacaaacgggagaacaagaatatactccgatacgtttctccagctcttggttcaacgttgtctacggacagaaatggaagccgggaatcttcgtaggctatgccaagaatctgggaacaagtgatgcactatatgctcccaaaggaaatgatgcaaaactttatggaacaggaacagaccttaaccaattagttacggcaggagcagaactgacctacaatgtcccccactggaaattcgggttggaatatacattaagctctgcatggtatggttcgctcaatacgtccaatgggaaaattcaagatacccatgccgtatgtaacaaccgtattgttgccgttgccatgtttatgttctaacctctctatacaattattttaattatatctctgtcacctgtcaccgattgctgcttaacggtttgattattaacaattaacaccgtgacagcaataggtgacagcagtgtgacaacaataatgctgtcaccagaaacagataaactacatttcacaacgcggaggtattcactctggaagctccaggcaatcctatttatttcatgaatgcattacctttgtttctcgtggggaaacttttagtttcaaggcttgaaaccaaaggtttcgtaccgggaaactaaagtttcagcattgggaaactgtagtttcagcaccgagaaacaatagtttcaacgacatggaaactatggtttctccaagagaaactagtgttcccttatcaggaaaagcaaatgatctcctattgtctgacttttatctccttaactccacttcaaagctagcaccatctttacaactgaactgcaaaactgtttgcttcttatcagaagaaatcaccttgcaaaacggagtttcttctacattccattgcccttttatcgttacagtcacaggtatttcactactggcattttcaatccatggtcgtgaatagatactacgttcgatgcgtttcccatctttatcaaacgcttcatcgcttggaccgcgatacaaagctaaatccggttgtgccaccgtcaacttaatcttatcagcagatcctttatgaatcataaccagacaggaagtatccacacgttgtaataaaccacccggcaatgtcgtttcaggagtttcaaacaacacataagaaatgatctgttcggaaacggactctacaatatgtgcattccggtcttgctgtaataccttataagtgggcttctttgcaaatttcttcatcagagtttcattcgtctgaggcagaacagcgtattcataacttccgtttttcggtgcctttccatgatctacaaccaaagaaacccaatcaccctttgtttcctttcctgtattttgcattcgcgagtattgaggaaagttcttctcaaaccggatgggagttggaacataataacccgttcccaaatggtccacccatactttcttatctccttgataatttttccaataatcatgccctgctttatcagtaactgccaattggaagatagtcgtttctgtcgggaactccgtatttgtattttcaatatccgaaccaagacagacaatcattccatcgatgaaatggtaagatttacgtgcccgatgtgatccgttatacttatcatgctcatgtaacttcattccgaaattaccattcatcttctgttgagacaaaccaccggcaaaagcctcgtcggagtaaagcatctcttccattccagagtaactatccacattgagcaccttagcctgcaattgctccaatggcaaatgaatagatgtcactcccggaatacggttccagtcaaaaccttcctgctgccagccgctagtggcgggagttactgtctgtcccggtgcagcagtcaatatttgcaaactgccgtgtgccaggtagcgaccgtatagatttgctcccagataatgttctgccgcccatagataacgggaatgtccacgtgccacagccgaccaattgctacgacgttgaacagagacgcaaccatatcccatcgctatatttccctgcgggtccggttccagacggaaacctttctctataagaagttttgccaccttacgttcttcagcatttgaaaccttaggcatatattcgggagagtcatttgcaatacttgggtctgaaatcagacggaggtaagaagaagccatttcactatcatattcctcctttccatcgggagaaccagctagagccatcatagcaaaatgcataggaaccagtttaccttttccatccggatgacgaccggacatggaaagagggaagttcagcttattgcaatagaaacgcatggtcaacagtacatttttcactgtttcatgagctaactcggaaacagcaaattccgtccggctgaaaagataaatcatattggttgctccatcgagtccgcccacagcataagccggatagttatttcgatgatggaaagcacctccgtctactttaaacgaaccggataatcccaatgcaggacggcaaccaaaatcaatccaacgggagaaagaccggagatattgtagtttttccggtgtatcttccatcattaaaatgctggcaatgcgtccggtggtctgtgtattgaaagagtccatatcaattccattgacttccggtttagggtatacttcgttagtaatcgcataccagcgtaatgtccgttcggcttcctgaagtttcccggtttccctaagcacatctttcatcagaaaatatgccaggtacagaccgcgaacactatagccataatgatggatgtttccccaacaactaccataagctactccctgatcggttatatgatcgtacattgctaagaacttcttcttcatttcttcccgaatcaccggatttgccgcattattatatgcaacggcaattcttttcatcaggtcgaaataagcacgcatttccactcccattttagtcagcatatctttatcccagtttggtatgatccgttcataagcttctgaagcacgtaccatgtaaataggtactcccgatacttggccgttcttgtaagttatctgatagaaatcatatttcttgcggatggtttctacttctttatcagtcgtttttcctttcgtgtagatcatatcacgaaaacgcttttccaacagttgcatttctgctctttgcttatcgtctacaggagtcaattcaatatccggtttcaaaagcgagtgttgatagacaaccagccaatggttggtggtcccggcattgacaaaaggaacttgcagatcggccgtctgttgacgtgcatcaactttagtagccgtaatcaaatgatcgatgaaaaggcttccttttgaatttggagcaataatccggagttcattcatgccttcttccggtgtgccttgcatatcacgttcatagcaaacccatgcggcacgccaaccactgaaattaataccaaaagggaaagatgtgcatcgtttgccgtctttcagaaactgaaactcaatggtcgcatcttggggaacttcattataaacccacacaataaaagccgaaagatataaatccttgccggtcggatctttcttctcaaacttcaggtctttcttgagttccaatataccacccggttcaaatgtccattccaacgaatgttttccatctttataatgcagatcagataccgacaggcgggaatgggtagcggtgatgcaatccggtatttgcggttcttcaaaagaaaacatccgttcatctgttacaacttgagcatgaaggaatgctgagcacaaaagagaaaacagagttgtcactccaaatttagtaaaaggttgtttcatcatggaaatatagtcttattaggttttcagtatataagtcaaagtatagtcgctttaaaatctgtaaagagtacgtgattctgcaaaagacgtaaaccgaagtgtccgtcaccttcaccacccgcaagggtatagcggaacaactcttcatcattcacagaataagttgtgattcccttttccactcgaatccgaatctcataccactgattggggacgagtaaatgagaggcatcggtatattctttcaataaaggtttcaccttgtcatctgccactccataatattctcctttgtatcgacggaaacgggtcgttgaattatcatttcctccgtatccaacgtagaaaaggtttaatgtgttatagtttttaaagatgccgtcacgccactgactacgggcaaaaagatcatcagggtatttaggatcattggcagcccagaagcagttcagatcactcaagcggtcatactttccaccttgcatcaccatacaaatacgataacttatttcataatcgcccgtcaatcgttgccgataccacatagtcagtccgtccggaactatcaattctaatgtatctgcacgttctattatctgcaaagcatgggatgcatcttctattttccattgctgcacaaaggaagctttgtgttgtgccaaaagcaccacactatttaagagaaaaaaagtaatcaaactgtagcctataaaaaatcgcttcgtcattacggtattagtttaaagattattcttccgaatacaaagaaacccctcttttcgaaaaaagaggggttcaaattgtacaaaataactcaaataacgtattgactgataatttgcattaccaatatcttatagttttttcatcaacaaagttctcataccatttctggtttgaagcacccttactatctacccatttagtaaaatcaggatatgcttctctaaatggtacacgttcataagcatgacgtgtgccaaccggaagtttaactccccaagtggaacctttggtatttgaataataaacatttgcatccagtgtagtgtcacccgcaaccaatgcttcatattctgctttgtaagcagaagtcggtgcataacccctcatgtgtatttctttaccaccgttcaccttaataaagaaattctgtctattagtatctaaaatcaactctctaaatgctgcaagctgagcatctctttcagctccagttaatccttctttaccaatcagtctaacttcagcacgcaacataggtagtccttctcttacttttccttgtgttacctgaaacatatcctgattattatccatcaaagaagttaaaccatccagtgtaataacagttccttccgcttgtgctttatccactgtcaatattgcgaaacgcggttctttgcgagtatcattactccaattccaatttttattttcaactttcactatattttttgtagaaagttcctctttagctaagtctgtcattgttccctgaccaccttttagtacaaggcttgcagtaatccgatcaacatactcgcttttcaaaccatccagtacaacacctaacacagtcgggtatataccacctacagcacgaacatccaaagtcaacaacaattcttctttacctcctacagtctccatcatctgttgactatgacattcagtcaccttcaagtcatactcgaatacaacatcgttgagatcttcatcataccatgaatccagttgaataggccaaccatcttcgaacatcaccacacctgtgttatgatagaaaagatagccttggtccgtttcatttgtcggctgcactgcatcttcaggaagcgcaagagttaccaatgccagacggtttgtttcaaaattgaaaccagtactctgatctacaccacgactaacaggagacaaagcaaattcttttgtagcttctgttcccgaaactgtattgtatttcatatacactttctcgcaagcagcaggaacattcaacgtaagagtacgggaatctttcactaatacatctcccacaagcagactcgcttcagaaccacttttatcggaatatacattcacaagtgtagaagcatttaccgggtcaacagttcccgaaccatcgttacctttttccaactcattatcagagcaggaagtagtaaccaacattgtccccataaggacatacatcaaacttttaattttcatcttaatttaatttttaaatttattgtttgtttttgtttcgcatgagaacctggcttatcacacttatttccaggctccatttgttaacttatcaaaaatatatttaactcctaatagctttttgcttgcctttatttgtaatttcaatcctttccatcgagaataatcacaagagctaaaatagggctcaaaaggcctgttcatgaacactggataatatatacaagttatttcgtatatttgcattagacagaacattcaatacaacaaatatagagcttttattccgaatatacaagttctatatataaatatatcaagggaaatggatcaagtactgtatggtatagattacatagaatattatttctattggatatattacaagtttattggctatcctttaatcataagaatatgctcaattgctgtaatgttttgtattattgcgtacttgtttctcctattccatattatatatggtatattcaaaaggcggaaagagaagcgaagatacaacaaagctttcgacaaatattacgaggaaatgaaatctatctcgctagattctaacacattaagtgaagaagaaatcgcagacagattacagtatgatacgaaaaaacgtcccaagcctaatgaattacgtattatcactcaactattaacagaaatcaagagtgtacacgaagatgagattaacgaactaaactatcaaacgattcaaaccgtattccagatcacgcgtttccttgaacgcgaacttcaattcggctccaaaagagcaaagatacaagcgctgaaacttattcaatccatcaacggatatgcctctgaagcggtattggtgcgcttcctctatcatcgtgaaatagaattgaggaactctgcacgctacacttatatgtggctaagccagggagatccgttccgtttcttcgacgaagacatcggcatgaagttgagacaatgggatatgatggaattgcatgccatcttggaacaccgcaagaaggtgggatataacacaccgagctttataaaatgggtgaatacttcggccgaagagaatgttaagatattctttatcaacgaaatccggttatataatgaaaccgatagtgctcccattctggctaaacaaatcaacgcacgctctaccgaaatccggggcgaagcgatcagaactttaggaaagctaaaatataaagagatcgagcccaagctgattgaaatgtatcatgtgcaaccggaagaagtcaagcgacaaatcatttcggctgttgcagatctgaaaacagataaggcattaggatttctttacaatgcttatgatgaagcagacaactgggggacaaaacgtatcatcctgaaagccctctatgaatacagttcaatgggaagaaaaacattcgatcaattggagagaaaagctgattcccacacagctatattgtttgcccataccaagcatccgttaatcaaccagttaatttagagaatatgagagatataatatttacattcttcaattatttcgtattcttttatacgagtatgctggcgatattcttcgtcacattcgccttcctctctttcatttctctgaaacggagaaaagattactatgtggaaagctatatgcggaaaacgattaaggaatctccctatacaccgggtatttcggtaattgcccctgctttcaatgaagaaaagacaatcattgataacgtgaactctatgctcgcattggaatacccgcttttcgaggtggtgattgtaaatgacggaagcacggacagtacgttgaagaagatgattgaacattacgaactgatagaagtgccctatgcctatattgagcgaatcaaaaccaaaccgttcagaagactcttcaaatctaccagtccgaaatacagtcgactcatcgttgtagacaaagagaatggaggaaccaaagcggatgcatccaatgcaggtatcaatgtttcttcatatccttatttcatctgtacggacgtagactgtatcttagagaaatatgctctttaccgctgtatatcgcccatcatatcttccgataaacaggtaatcgcagtcagcggaacgatgttgatggcaaacggatgcgtagtgaaagacgggcagatagtagacgtgagaactccgcgtactccgattccgcttttccagaacctcgaatacatgcgttcctacctgattggtaagatgggatggtctgcaatcaatggtatgccgaatgtttccggtggattcggtcttttcgaccgttccgtagccattgcagccggaggatacgacggtacttcctttgcagaagatatggacctcattacccgcatggtaggatacatgtgcgacttctcccgtccttataagattattcagattcctgatacttgctgttggacggaaggacctcccaacttggcgatgctttaccgtcaacgtacccgttgggcacgaggattgttccagacacttagtatccaccataagatgattttcaagaaaacatataaacagatgggattgctgactctgccttatatgttcgtatttgagtttctggcacccatcatcgagcttaccggtttgatcgtatttatctatctggcctttacaggagcggtcaactggaatacggcgtggatgatttacctgacgatctatacgttctgccagttcctttccatcgtcgttattacctacgactattacgtcgggatgctttataaaagaggatacgaatatctgtggattatcatagcgtccatattggagcccatcttctatcatcccatcatcactttctgttcattgagaggataccttagctatctgaccaatagagacttcaagtggaagaatatggagcgtaaaggattcaagcagaaagaagaaaatacggatgatgctgaaacagcggctatgaagcctgaaccggcaacgatttaaacaagaaagaaagattaaagacaagatagaatgaacagagaatttctccataagatcaccttattaggttgtctgtttttgctgataacctcttcctccggaaccgataatggattccagacaccggagcaatatgcccagattgtgcaggagcattttgcgaacgaggaatgggaagcagggaaagagctgttggaggagggccttcagaaatacccgaatgtttctgaccttgaatggctcatgggcaaatactggtttcacgaaaagaattatgaccagtcgcgttatcatcttgttaaagcaatagacgacaattataacaacgtcaatgccaaacacctgctggtagacgtggaagatattaccgaaaactactccagtgccatttgctacgttaatgagttgctggaagtgaatccgtattggagaggcttatggcgaaggaagattgaactataccgcaagcagaacaacgatgtggaagcggatcgcctgttgaaacgaatcaatcagatttacccgaacgataccattctaaggaaggattacatctacagcatggaagtaggctaccaacaaatgaaaaaaggcggtaaccggaaagaagcgatcgagagactgacggagctaatcaaagtatctcctcaaaacgaagaatattacctggacatcatcaacctgcatttacaggaaggaaaccgggaagcagctctaggctggtcatccaacggtttggctgccataccgggaagtggtgccctcatcgtcaaaagggcaagtatcctcagtgaattggcgcgttatccggaagcactggcatttatacgcgagcaaatgaagagaaacaatagtcctgccatacggcgtatgtacaacgacttattgatggaagctgcccgtgcagagaaacagcgggacccttatgtattatatggcatggcctacgaaggaggcaacaagaacaaggaagcattagactatttattgaacacttccgtcacccgcggatataccgacgatgccctcttctatatcagagaggctaaaaaacaatatggcaacaatgataaaggaattctctataaagaatatatgctttatcgccagatgaatgaggatgatcttgcctattcaacgctgaaaaagatgtacgagatgtatcctgatgattatgacattacgcttgccatgagcgcacagcacatgaagaaagccgaaaagctgatggaactcggtctgtatgcggaagcattgccgcacgtattgtttgtatctcaaaaacatgtagacaacgacgtgaacggtgccgcatgggaaaaagccttgagttgttatatcaatatgaaacgctacaatgaagcacttgccacattggacaccatcacccttcacttcccggattacgagaatggtacgttgaaaagggcctttattctcgataaaatggacaaaaccgaagaggctttgcaactatatttgtctgccatcgagcagagcgacgaggatatgcgtatcttctacgtcatcggatacgaggaactggcagtgccctacatcaaaaagtgcatggaagccggagctacgaagaaagcatacgaagaagccatcaaactggtcagcctgaatccatcaagcgatcttggattacggtatgccattaactcgtccggtttactcggaaaatacgatgaattcgagaaatatacagcgcaaggaatcaattactatcctgaagaacctttctatcaggcaaagagggctactgtccttgaacgcgacaagagatacgaagcttctttggaattcctgaaaccgatactcaataaatacccgagcaacaaagagattataggcgcattctcacaaagcagcgaatatcgtgccctgcaactgacaaaggcgaaagaacccgaaaaagctctcgctgttcttgatacagctttgctttacgacagccagaacaagtcattgaaatacaccaaaggcgtggtatatgaagccaacagacaagcggattcagcctattattatcaaaagtattacgagccttccatcatggaataccgttctttccaacggcacttatcgggccttagaagcatgatgctcaagaatgagatcgctttgacctacctgcgtgcacgctacggagaagaagacatcattacctccgttgccaccgccgaatacacccgaaaaggccagaagaacagctacacgggacgtctcaactatgcaggacgaagcggctcggcaagcgacagcatggaggctgaagaacagacaccgggaggggtcggcatccaggtacagggagaatggacgcaccacttctcaccgaagtggagcactacggtcaatgccgcctttgctaccaaatacttcccggatattaccgccgatgttgccgtacggcattatctcaagaatgactgggaaataggagcacatgtgggatacagacgtgtagctgcctatacgaaacgttatgaatggaacgacgaattctttgcaggaggcaccggagataacggttatctatttaccggctggaatgagtcaaagaccaacctgctcaccgtaggcggagaattagccaaaactatcgaagtcgttcgcctcaacacgaagatagatatgcatttcttcaattccaacttctactacaatgcacagattggtgccaaatactttccggctaatgacggaaagacaaatatcaacgccatggcaagtattggatcggccccggaaacggctgtattggattacgcgctgcccggctctttctcacacaccaatacaatggtaggactgggaggccaatacatggtcagtcctaatattaccataggtctgatgggtacctggaatacctattataaccagaccaacaccgtgcgagggagcagtccgctcaacccgatagaatccatatcgacacgctataaaaacttatataacatctatgcacaagtctatatttcattctgacacgctttgccccatattggcaggaatgatatgtatttgctgccttttatccggctgccgcatgcaggcacgcacggagatgttcccatctaaagaaggatacctcatcacaatcggcgaagatccgacggacagagatacccgatgggccaaatacctgtacgagcacctcaagaaacgtgcaaacgacgatgaaatggtcgctttcggtgtctccgagatggatatgtggcgtatcatcatacagatagacccaacattgcagagaggattcaaagtagcctgcaaaggttcggatatcagactgaccgcaagtgacgacaaacaaatgttatggctgcaataccaactgataaagaagatcagcaaagaagacccgcgtatagacggttcagatcttcctcccgcccttatcaatctcaacgatacttgcggagcttttgcatttgactatcaaagtatttattctccatacggcctgaacgccgatcatacaggcgttatcggcctgaataactttgacgacagctggggaatatggggacacaacctgcgaaaagtattgggaaaagatgcagagaaagtatatgccaccattcacgggaagacagatgactcacaactgtgtttctcttccgaggatatgtatcgccagatagaaagttacatcgtagataacttcggtgaaaaggggaatttccgttttgtaatcgcaccggatgatactccgtacgcctgtacgtgtgccacctgcaccgcattgggaaatacagagaagaacgcaactcccgccgttacggaactgatcctccgcctgtcgcagtgtttccccaaacacacgttctttacgacttcctacctgactacgcaacaagtcacagacaagcaacttccgcctaacgtcggggtaattgtcagcgctatcgactacccgctccgccggacagacggcaaggacgagcaagacaagaaatttgcggaacaactcgacaactggaagaaagtaacgaacaacatctatatatgggactatatcaacaacttcgacgactacctcactcctttccccatattaaagatagcccagcaaagactccaacttttcaaacaacacggagccagcggcatatttttcaacggaagcggctacagctattcttctttcgatgaaatgaggacttttgtattatcagcccttcttatcaacccggaacttccggttgatgagttaattaaaagctatttcaatcaggaatacccggtatccaaaaaatggctgtacgattactacacagagctagaaaacaacgcccaatccggaaagcagctcggactttacgccggtatcagagaatcggaaaaaggattcctctatccggagaagtttatcaaattctatgatgaaatgggagattttgtatccgaagcaaaagggaaagagcgcaaaaagctgcacgagctccagaccgccttgtctttcacacgcatggaattggcacgtgaccacggtttcgacgcttacggatatgccaagcggaatggaaaggatattcagccgctcccccaagctcgtaattgggtcacccagctcaaagagcatcaagcatttgccggaatggaatattataatgagtcagcttatgagattgactattatataaaggaatgggaacaatatatacttgcttccgacataaagaaaagtttgtttctgggaatgaatccttccgcaacccctaaactaaataaaaatgattcaaagaaactgaccgacggcactcacggtttacccggagactatcattgcggttgggttatcattccgggagaagaatgtaccatcaacctgccggttaaaggactcaatgcatcaggaacattctatatcagttttctgaatcttccccgccaccgcatctatgctccacagcaagttcaactgttgaaagacggagtagcctataaaacaatagacttgaaaccggaagactccccagaaaaaggagaaatgatgaaagccactgttccggcagacctgaacggaacagaacaattaagcataaaaatcagttgtttaaagaaaccgggaacgcaaatgggtatcgatgaaattgcattcatcccttagatgctgaaaaagtgatataacaaaaataaatggcaacaatgaataaatctatattctatattttactactgacggcacttccgctctgctttacagggtgcaggaaggaagtacgtcccaccagcatgacgataaaagattccgtcaggcactattaccctatcaagcaaggtcagcaactcgatatcatgtttaccatcaccaacacgggagacgctccgttaatcatttcagaaatgcaaccttcctgtggctgtatcattctggataaaagttcgcatatcatcattcccgaagacggtatcaggcaattcaaggcaacctacaacagcatcaagaatgtaggcgaagtggttcaccgcatccggattttcggcaatatgctcccaaatggaaaagcagaactaaaatttgatgttaacgtagtccccgacgcagattatacacgtgattatgaagaactctatcaggatttcaacactaagaacggtattgtcagggagatggtggacggaaaagaatcggagttaggatattatgtaggagaaccctaataataagtattaagtattagccagtcatttaatactgaatacttgatacttaatacttatctctacggatgtatttctttgaatgtggtattttcttcttttacattctggatggtttgttttaactccccaatcggcaagtcatatccataccagcctgtatagcaatccaccacataccatttcccgtcagcctgcaattcgaactcaacacgcaaatccacttcggactcttcatagcccgcttcaaagattttgtgtttcggttcattcagcgtaaacttggagacatagattcccccttcttcctgggtgatacgttcttccttcatggtttcgctatccagcaacggccatttttccttggtgaaagggaatgttttttcggtttcgccgtcatctgccaataaagtaatcggggtctttaatgggaacttgatacgagtatactggaaggctgcactggaagtaaatttatccagaaacgatttgaaatcttcaccgttttgcgtagtcagttcactatcggcttttgccttggaactattaccgcaggagataaacgaaacaccggcgagcagcagcatagccagcaagcagcatacaaactttttagctctcataacactatacaaattaagagtttaattgacggcgcaaagataatgacaagtttggcatcttggttattttaagaactaaatatttgcgcctatataatcaatttcccaaatctatgtatgtttcagatattcataaccaaaacgacagtacagacactttcgcttatcacagtactctttttgcaactgtatcaatgcctgactatccgctgcactgacaaccgcaagtccggcatcgctccacgaacggataatatgattactctccgccttcaattcttccagaaaacgtccggcacgttcaaacattcgttcatctgccttatgcaagccgtatgtataaagaaaaggaaccactgtattaatgattatcaaatccttggaacgctctcccatcgccttctccttttgtgaagaaagtcgtccgaataaataatgattttcccaatagggagacgtacgggcatccagcagcgttctcacatccgccagagtttccgcttccagtaaacgtgaaaacaacttatcccctttctgatagagataagctaattgcgccaagcgaatatgcggaaagttttccggacgaagccgtagaaaacgccataacgtagcgtccatcccctgcccgatttcaaacttccgctgtaaataacggaactccttacaaagacggagactatactcgtcttcctgttcctttttcagaaacgtctcttccaacaatcccgccaagccatagaaaaaagcctctatctgaaacaaatcattccggtgcttatccatcgcacgaaacggtaataatcccgcccacgtttcaaaagcatctccattcaagccaaaaccgaaattacgggcaagggtgataaagaatgcatcttcccaattacggttacaaagcgcgagacgctgtgtgattaattgcgctttctgctccaaacgttccgtttgcaaagcggtcagccaggaatgaatggtaagtttgggaagagaggcaaggatgggatggcaagccggatactgatcggctacacaaagttcgtggtaatgtaattgcacattgtccggacaagtaagtaatagttgcggtatctgttcaccgttggtacgggttatttccgtatctgcttcactcactacatggagaatcacagagtcgtatgttttgtcagaatgatgtccgtggcggaaccagtcggaagaatgtgtatgtatttcgatgtttcccacccataaggcgccgtcaatctttagtttcgcgttgaaaaagtcgggaccggcgttggggttttgcagaccggggtcaatcacttctaccggtaagccgttggtggtttgcagtactttcaggggaaataatttatgtttccacacgtagtggagaagatgttccatgttaacaagacgttaatgtgcgctgcaaatgtaataaaaatcttatctttgcgactattattttgaatataagtcagaaaacaatgaaaatagcactgatcggttacggaaagatgggcaaagagatagaaaaggttgcccgtagtcgcggacatgaaatcgtctgcatcattgacatcaataatcaggatgacttcgaatcggaagcattcaaatcggccgatgtggccattgagtttaccaatccgatggtagcttacagcaattatatgaaagcgttcaaagccggtgtgaaactggtatcgggcagtaccggatggatggcggagcatggcgaagaaatcaagaagctctgcacggaagggggcaaaacactcttctggtcgtccaacttcagcctgggagtcagcatcttctccgctctcaacaagtatctggctaaaatcatgaatcagttccctgcttatgatgtcaccatgagcgagacacatcatatccacaagctggatgcccccagcggaacagccattacactggcggaaggtattctggaaaagatagaccgtaaagacaaatgggtgaaagggactttccttgcgccggacggaaccattagcggaaccaacgattgtgctcctaacgaacttcctatcagctcgatccgtgagggcgaagttttcggacttcataccatccgttatgagtccgatgtagacaccatttctatcacccacgatgccaagagccgcggcgggtttgtattgggagccgtattggcagccgaatatactgccacacacgaaggttttttgggtatgagtgatttattcccgttcttgaatgactaaaatatcagaagctagttctaaacaaatataacattatgagacaagccacacgcgcacaatggatcaaatgtgccactgctattctactttacctcatcttccttatctgggtacggagttggtggggattgattgttgttcctttcattttcgatatttatatcacaaagaaaattccctggtctttttggaagaagtcgaagaatccggctgtccgcagtatcatgagctgggtagacgccatcgtgtttgcgttggttgctgtctacttcgtcaatatctacatcttccagaattatcagattccttcttcttcattggaaaaatcattgctggtgggcgacttcctgtatgtgagcaagatgagttacggtccccgcgtaccgaacactcccctttccatgccgttggcgcagcatacactgcctgtcttcaatactaaatcatatatcgagtggccacaatggaagtacaaacgggtaccgggcttcggcaaagtgaaactgaatgacattgttgtcttcaacttccccgcaggagatacggtagcagtgaactaccaacagacaacggacttctatacgctggcttacggcgaaggacaacgtatctattccaaacagattgaaatggatagtctgacacgcgcccagcaacgtgctatctatgatttgtactatgctgccggacgtaaacagataatgaacaacccgcgcacttacggagaagtcctctggcgtccggtagaccgtcgcgagaattatgtgaagcgttgtgtcggcctgcccggtgacacccttcagattgtagacggacaggtgatgattgacggtaaagcgattgagaaccccgaaaacctgcaattcaactatttcgtacagaccactggtccgtacattcccgaagatatgcttcgtgaactgggtatcagcaaggacgacaccatgctgatagaagactccggctgggaaagcggactgctggaaatgggactggacagccggaatgcacagggcaaactgaatccggtatatcatttcccgctaaccaagaagatgtatgaaacgcttttgggcaacaaaaagctaatcagcaaaatagtaatggaacccgaagattatgccggacagatgtatccgctcaatctttataccaaatggaaccgcaacaattacggtccgatctggattcctgccaaaggagctaccattaccctcacagaagacaacctgcctatctatgagcgttgcatcgtagcctacgaaggcaataagctggaagtgaaaccggacggtatctacatcaacggtgaaaagaccaacgagtataccttcaaaatggattattactggatgatgggtgacaaccgtcacaactccgccgactcccgttattggggttttgtacccgaagatcacgtagtgggcaaaccgattgttgtatggctatcgcttgacaaagaccgtggatggttcgacggcaagattcgctggaaccgcctcttcaagtgggtagactgataagtgtacggatagaatagagtgataaggtgataaaagttgatgaacattcgtaaattcaaatggatactagcatttgccggagcagtagccgtagtgcttctgctccggggatttgctttcacgtcctgccttatcccttccaccggcatggagaattccatttttcagggtgaacgtatcctggtcaacaaatggagctacgggctgcgggttcctttcatgtcgcttttctcttatcaccgctggtgcgagagtcccgtgcgtcggcaagacatcgtagtattcaataatcctgccggaatacggcaacctgtcatcgaccgtcgggaaatctatatcagccgttgtctcggagttccgggagatacgttgttggtcgattctcttttctccgttatttctccggaggcacgattcaatccggataagaaaagactttattcgtatcccgcttcaaaagaaaatctgattacgtcactcatgcataccctttccatcaccaacgacggattgatgggaagtaatgacagcacccatgtgcgcagtttcagccgttacgaatattatctgttggaacaggccatgaatgggaaagagagttttgtccaacctttgtcaaacagggaagatgccgaaccgaatccgctgattgttcccggaaaagggaaatttatccgggtctatccctggaacataaccttactgcggaataccctcgtgatgcacgaaggcaaacaggcagaaataaagaacgacactctctacgtagacggcaaacctacacaacactgttatttcactaaagattactattggatgggatctaacaataccgtcaacttttccgactcacggctcttcgggtttgtcccgcaagaccatatcatcgggaaagcctccatcatttggttctccaaagaaaaagagacaggcttgtttgacggataccgatggaaccgtttcttcagaacggtgaaataatcttccggaacataaaagaaataactccttaataatatccttaattaatatccttattatagagccccctaaacgtattaaaatgaaagaaatgaaaatagcttatttatcttcagcttatctcgctcccgtcgaatattataccaaacttctggcttatgacaaagtgtttgtagagcaacacgaccactatatcaaacaaacctatcgtaaccggtgcaccattgccggcccatccggcgaattagctctttctatcccaaccgtaaaacccgacacattgaagtgtccgatgaaagatatccgcatctccgaccacggcaactggagacatctgcactggaacgccatcgaatcagcctacaacagtactcctttctttgaatattacaaggacgacttccgtcccttctacgaaaagaaatacgagtttttaatcgatttcaacgaagaactatgccggatggtctgtgaattgatagatattcaccccactatggagcgtactagcgaatataagatggagtttgctcccggagaattcgattttcgggaagtcattcatcccaaaaaggatttccgagaagtggatacagagtttattccgcaaccttactatcaggttttcgagcccaaactgggttttcttcctaatttgagtatcatagacctgttgttcaatatgggaccggaaagtctgttggtactaggcaagtaatgactccactcttctatacgtatgtagccaacaaaggtgcaccatgtcgtcacattatttatactcgtacagtttgacgtgtaaaatactgaattctccgacaggaatacgtacatgccttccctgatggtcctgatcgccattcaggcgccggatatatttcagtgaaccatcttcgttcacattaacttcatctacagaaccgataccggctctcataccaccttgccagctattttccgtttttgatgcctttccgcccacactggcaaaaccatcctcgcccaatgccggtgaacttttcattttattttccccctgtttcttaaattcaagtaccaagccactgccggcaacgatatactcatctggagccagacgtagcaaaacacctcccccttcaggccatacagtgccatcccgggcacgtgggtcccatggcagagtgaagtaatgacggcaggtaatctccaaatcatcgtatgaaagtattcgttctttattctcttcatcaaacaaaagaccgttcatcactcctttaccctgatattttgtcaataaaggcatcagttctttcaatttaatatagctctgtaccaaaggtgcatctgctctatccgaaccgctttcaatagagaaaggacaaaagccaatcgcatcatgctcaccaaacacatagaaagcacgtactccatcattgtcttccaaccgaatttcaggtataaagagaggattattgtgcagtttatactttgccacccaatcaacgaaacctttatcatataaatccggagccagaaaatcaatgttgggtgctgcataatgccatacatctatcaaatgagccaatggtcctgccgacggatattctcccggtttccgccccctactgttcattgctgcattgacatacaacggaatattatagatagaacgtgctaactttgccattcgttctacatactgcgcatacgaccaggccataaaaatttcatccgtatacacgtctgcaccaaacacttcctgccacgtacctttcttcttgaatccctggctctcccattttgccaacatttcgggatgcagagatctcttgttcttttgcaaatagtcgatgaaaagagacggaactggtgcataaaacagtttatccgcttctttggaataatcgcgggcatcttccaacattccgatttcgttttctatctgaatcatgataaccgttccctcttccttatccacagaagcaatgtgtttcatccattgggaaaaagcacggctatccgcctgaaacacattctccgaaaaggaactggctatttcgaggggcttccctgctttcgtataggcacgcgggtatttcttataatcttccttaaaccagatcggagcatagcaactcattgagtttttccacgcaccgaaccaaaggaaaaccaccttcaaatcattcgcgcgagcctgttgaatcactttatccgtcagagtaaaatcaaatttaccttcctgtggttctgttaaatcccaatatgcaggaaccagtaccgtattcagccccatacgttgcaatttcgggaatatacgttcaatatcttcaatagaggaagctgaagaatttcccaattcaccgccaatcaccaagaatggctttccatctaccataagttgtgtggtacttccctgtttctgcaaatacggaagtttctgatgtgcctgaagaggcaaaataaaaaggaatagaatcccaaaaagtgtgtttctcataacaatcagctttatcatattatctgaaagcaaagttacaacaatataaaaaaggagcacaacgtcttgtgttccttttctatcgggcaggttacagatgctttatgttacgttacatttgcctttatctatacattatctccgattcttataccctctatttgcgtttcctaagtaatttttagagaaaactgtttatatcgctacttcttcacagttcttctcttcattagattctgccgcatccagccgattcaacaaatagcgtacattttgaagatgtatatcattattccgatccattttcttaaactgccaactgtttttagtggtattcagtatgcaattcattaacgttcccacggcatcggcactttggaaacgattggtattggagattagcgtattcatcatgtgcgccccgaatcctctaatcacctctttcacacttatcgacttataattacggatggcttcaaaggctgccacattactacaaagcgtactagctaaatcctccagtctctttcgatctgttcgttccactagatagctttcaggattcataaaacgattgagagtcagataaaaagacatcatttcatcatcggatgaaaagataacgtgcatgagttgcgtcgcgtcccccggacgagcctgctggttgcttaaaacttcttccataagaattttaattaaatggtgaataaattaagttcaatggggcgatacagaagggtagttttaagaaataaaagaagcggttccgcctgtcccattgctcttcaccatccacaacaggcagtaggtgcattaacatcctacatgggggtacgaaaccgccatatagaatgataggacaagcataaaaaagcctgccacattgatacagcaggttcccctgctgtggattttgataaagagcattgcaaagatagaatataaaatcagaaaagagaaaagaaaatcaatataaattgaagtttacaacgatcagcaaaagacaaaatcttctaaagctacttgtaactataagattcatttaggaggttcaccggtttcacctttagttgaatgagtataaatcagatgtttatggtgaaagagatacataaaataataaagaatcatccttcacctccttcacaaaataaaagtaagcgtcttttagttttacactcgaaagagagacttcttataagctttaagattgttaacggagaactagtaagcccccaagtttagatagctttttatcgatatagctccttagcagatattaacaagattgtttctctttctttcaaataaccagactaaaagatgcttatatcgtatagattaagggtctatacaccctatttgttgggcatatagatccaatgtattggtcatatagatctaacacgttggatatatatatcttgcaccttgggtatatatagccaacaactcaagtattaatagcctaaatacaaagtattaatagtagatagctcaaatgttaatacttgatggagcgtttgctatgagcttattaattttagcttatagcatattcgtttttgcttatagcatatttactttagcttatggcatataaaaagaacggtggtaagcgtctccgcgattctatatagtgtattaaaataaaaaggctaatgatcccagtttgtcaatgacggacaacttgctattttttgattttatttcgaactcacgttaatataggtgataggttgaaagaggattcttgtttttatctatgagagtgactgtccattcatttacccattgaaaaaggaaaatatgaatataaacaaatagtttgtggatagtctcattatgctataagctgctaaatttgtagccaataatagagcatatattatgaaaagactactattcattttttccttttttttcttgttcgtgttaaacggaaaaacacaggaggtagagattctgacattagaggattgcctccgcattggtattgacaataacttgtcgctagaaggaaaacgtaaagaaatacaaagaagtaagtatggcgtatctgaaaaccgttcgaagctgttgccgcaaataaatgcgatagccggttatagtaacaattttgatcctccggtgtccgtcacagacggatcatcttacggtgttccttataatataacgcagacgctgcaacattctgctaatgcaggactggaaatgcagatgccgcttttcaatcagactctttatacttctatgtccatagctaaagtgatggaagaaatcagtcgtctgtcttatggaaaagccagggaagatgttattcttcaaatcagtaagatgtattatctcggacaggtcacggccgaacaaatcatgctgataaaagcaaatatcacccgtctggaagagttgagagatattacacaggcttttttcgataacggaatgtctatggaagtcgatctgaaaagagtcaatatcaatttggaaaatctgaaggtgcaatatgacaatgcacaagcaatgatgaaacagcaattgaatatgctgaaatacattatggattatccggctgaaaaggaaattgcgctgacaccggtaaataccgatagcattactacagtagccctgaccggcttgtcggaaaatatctatgaacttcaactctcacaatcgcaagtgcaattggcggaacggcaaaagaagatcattactaatggatatatcccttctcttagtctgacaggtagctggcgatatgccgcatatacggataaaggttatcattggttccactccggtccgtccaatcaatggtttcgttcctatggagtggggctaaccttgcgtattccgattttcgacggactggataaaacctataaaataaagaaggcgatgatcgatatagagaacaaaagactggcatgggaagatgcccggaagaatttgcaaactcaatatctgaatgctgtgaacgacctgatgaacaatcagcgtaactttaagaaacagaaggataactacttgcttgccgaagatgtgtacgcagtcacttccgaccgttaccgggaaggcattgcttctatgacggaagtgctgcaagatgaaatgcagatgagcgaagctcaaaacaactatatcagcgcacattataactatcgggtgactaacctgatgctgcttaaactaaccggacaaatagaatcattagtcaaataatacgcaaataacaatcataaatatggaaacaatggaaaataaccttccttccgctactcatcaggagaaagcaaaaaaaatgaagaaacttcgtcgctggcagattgctatcagccttttcggagtggctattattgtttggggagtgattgaagtgatctgcctttttttgaattatagccagacggagactagtaacgatgcacaaatagaacaatatgtgtctcctatcaatctacgtgcttcaggttacattgacaaaatctactttacagaacatcaggaggtacataaaggagatactttgctggtactggatgatcgtgaatataaaattcgcgtaatggaggctgaagctgccttgaaggatgcgcaagccggtgcgaccgtcatcaatgctacactcaataccacgcagacaacagcatctgtttacgatgcgtctattgccgagattgaagtacggttggcgaagctggaaaaagaccggaaacgatatgagaacctcgtgaaacgaaatgcggctactcctatccaacttgaacagattgtcactgattatgaagctacgcgtaagaagttggaagctacgaaaaggcagaaaaaagcagctctttccggtgtagatgaagtgtcctaccgtcgcatgaataccgaagcggctattcaaagagcaacagctgcgctcgaaatggcccggttgaatctttcctatacggttgtaatagctccttgtgacggaaaactcggccgtcgctcattagaggaaggacagtttatttcggcagggcagaccatcacctatattcttcctgatacccagaaatggatcgttgccaattataaggagacacaaatcgagaacctgcatatcggacaggaagtatttgtcacagtagatgccattagcgataaagagtttaaaggcaaagtcacctctatatcaggagctaccggctccaaatattcattagtgccgaccgataactccgcaggcaactttgtaaagatccaacagcgcatccccgtacgcatcgacttcaccgatttatcaaaagaagacaacgaacgattagcagcaggcatgatggtagtagtgaaagccaaactctaaccaccgtgcacctataatttataaatcataattcataaatcaaaaattaatgccctcttatcctaaaaattatcctttctatagctggatgcccaaaccgttgggtattatcattctgttatttttctttctgccgattcttacggtaggcggggtttattcggtgaatagcaccgaaatgatgagcgggcttggcattatatccgagcatatccagtttgccaactttgttacttctattggtatggcagcctttgctcctttcctatatcagttggtgtgtgtgcggcgggagaagatgatgtgtattgtcgggtttgcgttcatgtatatattcagttatatctgtgcaaagacagacagcgtttttctgttggcgctttgtagtcttctgacgggtttcttgcgtatggtactgatgatggtcaatctgttcacactcatttggtatgcgggtggcatggaagctacccgcaatattactccggggttggagccgaaagatactgccggttggaataaattggacattgaaagatgtgtgagtcagccggctgtttatctgttttttatgattctaggacagtcgggcacagcattgacggcttggctgtcctttgaatatgagtggaaatatgtgtattgctttatgatggggattctcctgatctctattttgctcttgtttattaccatgccgaattataagtttcccggaaggtttcctattaatttccgtaagttcggcaatgtcactgcattttgcatctcgctgacttgtctcacgtatgtgctggtttatggaaaagtactcgactggtatgatgacgaatctatccgttgggcgacagctgtaagtattctttttgcgggaatttttctatatatggacgtaacgcgccggtcgccttatgttttgctggatgcgttcaaactgcgtactatacgtatgggagcattactttacttattattgatggtgataaactccagtgctatgtttgtcaatgtgtttgcaggagtggggatgcatctcgataatctgcaaaatgcttcattaggtaattggtgtatggtaggttatgctattggcgccgtgattgctatggtgttgggaggtaaagggttacattttaagtatctgtttgcgatgggattcttcttcctgtctttatcagctgttttcatgtatttcgaggtacagacagcaggagtttacgagcgtctgaaatatgcagttatcatccgtgccacaggcatgatgattctgtatgcgctgacggctgcttatgccaatcaacgtatgccttttaaatatctttccacctggatctgtattatgcttactgtgcgtatggttgtgggaccgagtattggcggagcaatttatacaaatgttttgcaggagcgccaacaacactatataacccgttatgcgcaaaatgtggacctgcttaatccggatgcttccacttccttccttggtacggtacaaggtatgaaatatcagggaaagagtgagacggaagcccgtaacatggctgctatatctaccaaagggcgtattcaggtgcaggccacgctctctgcactcaaagagatggcgggatggacaatttatggtgggttaatttgtatgatatttgtgctcgttgttccttatcctaaacgaaaattgctaacttagcgtcgtttttgataatgatctgttaatatattagtatgatggatagcggacaagatcgtttattgcagtttgatcgcgatttgttaagtgggaaaaatatatgtagctccgaagggatatttgtaaattttccaccctcactgaagaaacctttccaaatgaaaggactggggctggttatttgccgccagggtaatttccagttttcgcttaatcagaaaaagcatttcgctgaagcgggcgaaagtttgtttattcccgaagatggcgagtttcagattttgcaagaatcggaagacatggaggtgcaggttttgatctatcagatagaacctatccgggatattatggggaatctggttgtttccatgtatatgtattcccgccttactcccgaagaaccttcttgtgtctggtctactggtgaggaagaagagatagtgaagtatatgtccttattggacaatgtgttacagtcggaagaaaattcatttaaactttatgagcagaaattacttctacttgcattgacgtataggatttgctctatttataatcgcaaactcgttaatgacgggcgggaagtgggaggacgcaaaaacgaagtctttattcatttgatccagttgatcgaaaaatattatatgcaggaacgcggcgttgagttttatgcggataaattgtgtttgtctcctaagtatctttctgccgtttctaagagtatttgcggatataccgtgcaggaacttgtattcaaagcgatcattcgtaagagtatttcgttacttaaaaatacgcagaaggatattcaggagatttcaaatgccttcggcttccccaatgcctcttatttcggtacgttctttaagaagcaggttggggtttcaccgcagcaatatcggaagagtctttaagcgtttattctttttcaccataggcaaggtcgcctgcgtcacccaatcccggaacaatataagaatgttcgttgatttccggatcaatggcagcgcaccaaatggttgtcttgtcttcaggaaatacattctttatatggtcaatggccttttggctggcaataatggaagcaacgtgaatttcagcgggatgacctttcgtcaacattgcctggtaacttagttccatactgcctcctgttgctaacatagggtcggtgataatcagcgttttgtcatcaatgcggggagaagcgatatattctatgtgtatatcgaattttagcgtatctttatatttgcggtaagcggaaacaaacgcattttccgctccgtcaaaataactaaggaaaccttgatggaaaggcagaccagcacgcaggatcgtactgattactaaattgttgtccggcgtactgactggagcgattcccagtggtgtctggatgttctttaccgagtatttaaactctttactcatttcataagccatgatttctccgatccgttctatgttacggcggaaacgcaggcggtcgttctgaacttctacatttctaatttcggatatgtactggtttagaatcgaattagtttggccaaaatcaattactttcatattatattttaatcagattttaatctcattttcacagcattgctagcatactgacttgcaaagtaaacgataatctttcaaattgcaatattcagtttgcagatattgttaggaatttataaaagagtttcaattagggaaaaatttctctaataccttcttcctttccaaagaaagtattacttttgtagccggatttacaaggggctatccaaagctccccatgttaaggtgaaaagagatagaaaacaaaataccaattttaattaattcaaagaaaatggcaaatttagatttaagcaagtacggcatcacaggtgtgaccgagattttgcacaatccgtcttatgatgttttgttcgctgaagaaacaaaaccgagtctggaaggctttgaaaaaggtcaagtaactgaattaggcgctgtgaacgtgatgacaggtatctataccggtcgttctcctaaagataaattcttcgttaagaatgaagcttctgctgattctgtatggtggacttctgaagattacaaaaacgacaacaaaccatgtactgaagaagcttgggctgacttgaaagctaaagctgtaaaacaactttccggcaaacgtttgttcgttgttgatactttctgtggtgctaacgaagctactcgtatgaaagtacgtttcatcatggaagtagcttggcaggctcacttcgtaactaacatgttcatccgcccgactgctgaagaacttgctaactacggagaacctgatttcgtatgtttcaacgcttctaaagcaaaagttgacaactacaaagaactgggcttgaactctgaaactgctacagtattcaacctgaagactaaagaacaagtaattctgaatacttggtacggtggtgaaatgaagaaaggtatgttctctatcatgaactacatgaacccgcttcgtggtatcgcttctatgcactgttctgctaacactgatatggaaggaactagctctgctatcttcttcggattgtctggtacaggtaagactactttgtctactgacccgaaacgtaaattgatcggtgacgacgaacacggatgggataacgaaggtgtattcaactacgaaggtggttgctacgctaaggttatcaacctggataaagaaagtgaaccggatatctacaatgctatcaaacgtgacgctttacttgaaaacgtaactgttgacgctaacggtaagattgatttcactgacaagagcgtgactgaaaacactcgtgtttcttatcctatctatcacatcgaaaacatcgttaaaccggtttctaaaggtcctcacgcaaaacaagttatcttcttgtctgctgatgcattcggtgtattgcctccagtatctatcctgaacccggaacaggctcaatactacttcttgtccggatttacagctaaattggctggtacagaacgtggtatcactgaaccgactccgacattctctgcttgcttcggtgctgctttcttgtcattgcatccgactaaatatgcagaagaactggttaagaagatggagatgactggtgctaaagcatacttggttaacactggatggaatggttccggcaaacgtatctctatcaaagatactcgtggtatcatcgatgctatccttgatggttctattgacaaagctcctactaaggttattcctttcttcgactttgttgttcctacagaacttccgggtgttgatccgaagatccttgacccacgcgacacttacgaatgtgcttgccaatgggaagaaaaagctaaagatttggctggacgtttcatcaagaacttcgctaaatttactggtaacgaagctggtaaggctttggttgctgctggtccgaaactctaattggagaatcagatataatatggaaggcggttcgatttcgaaccgccttttttgtttatgcctgtgcctttctatgagaataaatgctgtttgtttaaaacttttccctatatttgccaaaacaggagtactaacctttaaaggcggttatggtatatctagctactgacaaacagacctatgcggatctaagcattacagagactgctaataatgagcaatttcttttctctttgttttccaaaacagagacaaaagaaggaaaagcgctgatgttgaactggattatgtatccgctaagtgatttgggggaaatccgtaaaagacaggaggctattgtctgggatgctttgcccgaacttcttttgaatgaagaagagctggattttattgagtattacctggcttatcgtgaccagatacgggaagctcatattttactttcatgtgctactgttatcgaccgtctggtgcgatatgattcgacccgttatgtgatctgcagaggggtgaaattagtggttcatctcttgcattgtctgaaggaatgggcgacagaactaccacagggcgccccgcaactcatgaaagaatctgctgctatgattgataatattctccatggaagtgaattggaggaagtattggagcagacctctgatgaggaaaaacgactatctaactttgtcatagacaaattcgattatctgttccggtgtactcggttgttatctttgaaggaacttctgtctgttatatatctacttgatgtctgccgtacagctcaccgggtggcaaaagagaagaacttctgttgtatgccgataatggtaccgacaatggacttctcggtggagggagtcgttcatccttttgtgaaagatgcgcagccaaacagttggcagatgtcccggggaaatatatgcatttttacaggctctaatatggcgggaaagtcaacaactttaaaggcattgaccttggctgtctggttggcacattgcggtttgcctgttcctgtgaaatcaatgatttgtcctctttacgaggggatttatacctctattaatctgccggattctttgcgggacggacgaagtcattttatggcggaagtactccgtattaaagaagtgatgcaaaaagctgtgaccggaaaacgctgtttggtggtattagatgagatgtttcgcgggacgaatgctaaagatgcgtttgaagcctccgttgccgtcaatgaattactgaaaagcttctctcattgtcatttcttgatatcgacacatattttggaatatgcgaaagcctttgaaaaggattcttcctgttgcttttattatatggaagcagaaattattgatgatgcgtttgtctgtcctcatcggttgttgtcagggatttcagaggccagagtcgggtattgggtcgtgaaaaaaatactgtcggatggtttgatgtaattttacctcattatagaggttgttgagattctgttttatttttattagatatatattttgactacttttgtacagactataaataggttattaatcttaaataacgacgcgacgaccatgaagaatttttatttccttcttattagttccctattccttacctccgggctttatgcgggagaaacagattatactcaaggactttccatctggtttgatactccgaatactttgcagggatatgttgcctggtatggcggaagaccggatttgtggaaagatgaaaataaaccggtaacagcaggaagcggacataatctggatgccagttgggagtcacagtcattgcctattggtaacggtagcctcggcgcaaatattatgggatcggtggaagccgaacgtatcactttcaatgaaaaaacgctttggcgcggtggtccgaacacagcgaaaggtgcggactattattggaatgtcaataaacaatcggcccatcttttagatgaaatacgcaaagcatttacagagggagatcagaaaaaggctgaaatgctaacgcgacagaacttcaatagtgaagtttcgtatgaagctgacggagaaaatcctttccgtttcggtagctttactacaatgggagagttttatgtagaaaccggactgaatatgataggaatgagcgattataagcgcattctttctttggattcggctatggcagtcgtacaattcaaaaaggatcgtgtggcttatcaacgcaatttttttatctcttaccccgccaatgtaatggtggtacgtttcagcgcggatcaatcggggaaacaaaatctggttttcagttatgcgcccaatcccctgtctaccggcagcatggtttctgatggaaataaaggactggtttacacagcttctttggataataatggaatgaagtatgttgtgcgcatccaggcagaaacaaaaggaggaacactgtctaatgcagatggaaagttgacggtgaaggatgcagacgaagttgtattttatatcacagcggacactgactataagattaactttgatccggatttcaaagatccgaaaacatatataggcgttaatcccgaagaaacgacaaagcagtggatgaataatgcagtggcgcagggatatacagctttattcaatcaacattataatgattatgctactctgttcaaccgggttcggctgaatctgaacccagcggtgaaaggagtgaatctgcctacttcccaacgtctgaaaaattatcggaaaggacagccggattattatctggaagagttgtattatcaatttggacgttatcttctgattgccagttcccgtccgggcaatatgcctgctaatctacaggggatttggcacaataatgtcgatggaccgtggcgtgtggattatcataataacatcaatatccagatgaattattggcctgcttgttctaccaacttgaatgagtgcgtgcttccgttgattgactttatccgtacactggtgaaaccgggggagaagactgcacaagcttatttcggagcaagaggatggacggcatctatctccggcaatattttcggctttaccactccgttggaaagtcaggatatgtcgtggaacttcaatccgatggcaggtccctggctggctactcatatatgggagtattacgactatacaagagacttgaaatttctgaaagaaaccggctatgaactaattaagagtagtgcggattttgcagtcgattacctgtggcataagccggatggaacctatacggctgctccgtccacttcgcccgagcatggtcctatcgatcagggagctacttttgtgcatgccgtagtgcgtgaaattctgatggatgcgattgaagcaagcaaagtgttgggtgtagataagaaagaacgtaagcaatgggagcatgtgcttgccaatctcgttccctatcaaataggtcgttatggtcagttgatggaatggtcggtagatattgatgatccgaaagatgagcatcggcatgtgaatcatttgttcggcctgcatccgggacatactgtttctccggtcactactcccgaactggcgaaagctgctaaagtggtattggtgcatcgtggtgatggtgctaccggttggagtatgggttggaagttgaatcagtgggcgcgtttgcaggatggtaatcatgcttatactttattcggcaatttattgaagaacggaaccatggataatttgtgggatacgcatccgcctttccaaattgatgggaactttggtgggacagcgggaatcaccgaaatgctgctccaaagtcacatgggctttattcaattattaccggctttgccggatgcatggaaagacggttctatcagtggtatctgtgcaaaaggaaattttgaggtggatgtgatctgggagaatcatcaattgaaagaagctgttgtacgctctaatgcaggaggcgactgtgtcataaagtatgcggatcagactatctcctttaaaactgtgaaaggacgcagttatcagattggatatgatgcagccaaagggctcattaaaaaataaacacaaaatatcggaaaattagaaagaaaggatggtactggagtatttaaaattattcgtgacatttgcgaagattggaatgtttactattggtggcggttatgccatgattccgttgattgaacgggagattgttaataagcaatggatgaataaagaagaatttatggagatgtttgctttgacgcagtcgcttccgggtgtgtttgcagtgaatatttctatttttgtaggatataagttgtataaggtgggtggtagcctggtgtgtgcattggctacgattcttccctctttcgttatcatgatgctgatagccatgttttttgcacagtttcaggataatgaagtgatgattcgtatctttaatggaatacgtcctgccgtggtagcattgattctgtttccttgcatttctgctgttagagctttgaaactgaagtattttcagttggttgctcctgccatagctaccgtgttgatctggcagttcggcttatcacctatttatattgtggtggccggaattatagggggattggtatatacattatggttgaaagaaaaaatagcgaataaacaggtatgatatattggcaattactttgggtgtatcttaaaataggtctgttcggttttgggggtggatatgcgatgctttccctgattcaacatgaaatagtggatcttcatcattggctgactcctcaacagtttacggatgtggtcgcaatttcgcagatgactccgggaccgattggcataaatagtgctacttacgtaggttatgcggtaacacaaagtgtttggggagctgtgttggccactgtagccgtttgcttgccttcttttattttggtgttgctcatttcttatttctttgcgaagtgtaaggataataagtatattaaagcggctatgtctggactgcttcctatgtcggtcgcgctgattgcttcggctgcattacttatgatgaatagagagaattttatagactataaaagtatcggtattttcgcagccgcctttttggttacatggaaatggaatcttcatcctattctgttgatttgtctggcgggtgtggtaggattactgttgtattagtaatacttatgggaaaaagagccccccggttaaacactgcgtttaaccggggggctcttttataatattatgaaagaatggttagttcttgtttgcacgtttacgttcgatttcgtccaaaatcactttacgcatacgcattgctttaggagtaacttctacatattcatcttccttaatatattccagtgcttcttcaagtgagaactggataggtggaatcaggcgtactttatcatccgaaccggaagcacgcatattcgtcaatttcttcgatttggttacgttgataaccaggtcgttgtcatgagagtgttcgcctactacttgtcctgcataaacttcgtcctgcgggaagataaagaatttaccgcgatcctgcaatttgtcgatggcataagcaaaagctgttccgctttccatagcaatcatagaaccgttcgtacgacgttcgatttctcctttgtgcggttgatattctttgaagcggtgtgccatgatggcttcgccggcagaggcagtcagtacattggtacgcaaaccgatgataccgcgtgaaggcatattgaactcaagattgatacgttcacctgtattttccatcttgaccatttcacctttacggcgagtaaccatatctataattttgctggaatattcttccggtacgttgatggtcagttcttcaatcggctcgcatttcacaccgtcgatttctctgaagataacctgcggctgacctacctgcaattcatatccctctcggcgcattgtttcaattaatacagaaaggtggagtacgccacggccggaaacaatccatttaccgtcttcttcactttttcttacgcggagagccagattcttgtcgagctccttcatcagacggtcgtggatatgacgtgaagtcacaaacttgccatctttaccgaagaaaggagaatcgttgatagcaaacagcatactcatggtcggttcgtcgattgcgattggcggcaatgcttccggattctcgaaatcacaaacagtatctccaatttcgaaaccgtcgatacctaccagtgcgcagatgtcaccggaagaaacttcgtttgttttcacgcggcctaaaccttcgaaaacatggagctctttgattttgctcttgagcatatcaccgttacgtttcgcaagcgttatattcataccttcttttaatgtaccgcgatgtacgcggcctacagcgatacgaccggtataagaagaataatccagagaagtaatcaacatctggggagtaccttccaattgtttgggtgccggaatattttcgatgatacaatccagtagcggagtaatactgtcagtctgttgcttccagtcggtgctcatccagttgttcttggcggaaccgtagattacggggaagtccagttggtcctccgttgcattcaggctgaacatcaaatcgaaaaccatttcgtaaacttcttccggacggcagttaggcttatctaccttattaactaccacgataggtttcaaaccgatttccagtgccttttgcagtacgaaacgagtctggggcatcggaccttcaaaggcgtctaccaacagaatacaaccgtcggccatattcaatacacgttctacctcaccaccgaagtcgctgtgtcccggagtatcaataatattaatctttgtactgttgtaattgatggatacatttttggagagaatcgttataccacgttcacgttccaaatcgttgttatccaggataagttcaccactattttggttgctgcggaataaatttccggccaatagcatcttgtcaaccagcgttgttttcccatggtcaacatgggcaatgattgcaatgtttcgaatattttgcatataatacctattatttggctgcaaaggtacgaaaataggattagaaatatgcgcaatgatagcaattttttcttgtaaatcgttgtgtgatataaagataatgcctatctttgcacgctcaaaagaataatttatcaattaaaattctaagaattatgtatttagacgctgctaaaaagcaagaaatcttcggaaagtacggaaagtctaacactgacaccggctcagctgaggcccaagtggcattgttttcctaccgtatttctcacctgactgagcacatgaagctcaacagaaaagattatagtactgaaagagcgttaacaatgttggtaggtaagcgtcgtcgcttacttgattacctgaaagcaagagatatcgaaagatatcgtgctattgttaaagagctcggtttgcgtaagtaatctacttgtcgcgaaaagatttaaagccgttcctcatttatagaggagcggctttttttagtttcttctttttcttcctgatagtcgtattttcttcggttataattgtgttcatctaaagattttgttatttttgcagcttaattattataatttatcacctttgataactaaaatgctttcaaaatggatacaagtaagattgttggcgaaaaaattaaagccctccgcgaagataaatcaataagcatagaagagttggcacaacgttcgggtttggctatcgaacaggttgaacgtattgagaataacattgatataccttctcttgcaccgctaattaaaattgcgcgtgtattgggagtacgtctggggactttccttgacgatcaggatgaagtaggaccggtggtttgtcgtaagaaagaagccaaagatgcgattagtttctccaataacgcgattcattctcgcaaacacatggaatatcactcgttgtccaagtcaaaggcggatcgtcacatggagccgtttattattgatgtgatgccaacggaagataccgacttcgtgctttcttctcatgaaggggaagaatttatcatggttatggaaggtatcatggaaatcagctacggcaaaaatacctatttgctggaagagggtgatagcatttattatgattccattgttcctcatcatgtacatgcttacgaggggcaggctgcaaaaatcctggcagtagtttacacgccaatttaatgaaataataggaaccaagacttaagtataattacatgcaattatttgatcgtactttggggcagtggctcgagcactgggctgaagagactcccgataaggaatatatcgtttattccgaccgcaatctccgttttacctggagtcagttgaaccgtcgtgtggatgatatggcgaaagggcttatcgccattggggtggaacgtggtacccatgtgggtatctgggcggctaatgttcccgattggttgacattgttgtatgcttgtgcgaagatcggtgcggtatatgttactgtaaatacgaactataaacaatcggagttggagtatctttgccagaactcggatatgcatacgctttgtatcgtgaatggcgaaaaggacagtgactttgtgcagatgacctatacaatgcttcccgaattgaaaacctgtgaacgcggacatttgaagagtgaacgttttccgtacatgagaaatgtagtgtatgtaggacaggagaaacatcgtggtatgtataatacagcggagattctgttattgggaaataatgtggaagacgactgtttgagcgaactcaaaagcaaggtggattgtcacgatgtggtgaatatgcaatatacatcgggaactaccggttttccgaagggagtaatgctgacacattataatattgccaataatggatttctgactggtgaacacatgaagttcacggcggatgataaactttgctgctgtgttccgttattccattgtttcggagtggtgttggccaccatgaactgtctgactcatggttgtacgcaagtaatggtggaacgtttcgatccgctgattgtattggcttccattcataaagaacgttgcacggctctttatggcgtaccgactatgtttattgccgagttgcatcatccgatgtttgatctctttgatatgtcttgtcttcgtacaggtattatggcaggttctctatgtcctgttgaactgatgaagcaagtggaggagaaaatgtatatgaaggtgaccagtgtgtatggactgacagagactgcaccgggtatgacagcttctcgtattgatgatccatttgatgtgcgttgtaatacggtagggcatgattttgaatttacggaggtaaaagtgatcgacccggaaactggtgaagaatgtccggttggcgtacaaggtgagatgtgcaatcgtgggtataacaccatgaaaggatattataaaaatccggaagcaacggcagaagtgcttgatgaaaacaacttcctgcattccggtgatttgggtatcaaggatgaagatggcaattaccgaattaccggacgtatcaaggatatgattatccgaggtggagagaatatttatccgcgcgaaatagaagagtttctttataaacttgatggagtgaaagatgttcaggtggcaggtattccttctaagaaatacggtgaggcagtcggagcatttattatcttgcaggaaggtgtgaaaatgcaggaagctgatgttcgtgatttctgtagaaataagatatcccgttataagattccgaaatatatcttctttgtgaacgaattcccgatgacaggtagtggaaagattcagaagttcagattgaaagatctgggattacagctttgtaaagagcagggaatagaaattatctagggcctgtaattgcttaaggacacacaacgtttttcgatataataaacgatgaacggtgaacgaactgcatgattgtttgcagagagttcaccgttcattatttatattattgtcttatccggcttttgttgtagcagctaagtattatacgctgctaaatgaaatcgtcacccagttgcatttgggcgtcattcacatatttacggatggcatgttcttcatctttgcggcagattaaaagaacattgtcggattctgctattagaaatccttccaatccatcgattacggccagttttcctttgggaagtactaccatattatttttactattataaataagcgaatggcatttcagagtaacattgccttccgggtctctttccgataagtcataaagtgatccccaggttccaaggtcagaccagccaaaatctcctaacgatacatacacgttatccgctttttccataataccgaagtcgatggatacattaggacatgcggggaaattttcttcaataaatgctttttccttatcggtggcataaatatcttttcccggtgccagtttggaagctaattcaggcaacaagtcttcacttgctttgatgattgtatttacattccacataaacaggccggaattccagtaaaattctccgctttctacgaatactttagctaattctaattcaggtttttcagtgaatgtttttactttatagaagtttcctcctgcgggttcatctatttgtatatatccatatcctgtttccggacgattgggtttaatacctaatgtcagtagcttttcagagcgtgaaacaaaatcaagtcctttttcgatagcggcaagaaattcatcctcttttaatattaaatggtctgaaggtgcaactacgatattggcatttggattcagtgcccggatatggtaagaagcccatgctatacatggagcagtatttcgtcttgcaggttccagcagaatttggttttcgctcacttcaggtaattgttccttcactaagtctgcatacattgcattggtaacgatgaaaatgttttctgttggaataaccttttggaaccggtcaaaagtctgctgtaaaagtgaacgacccgttccgaagaaatctaagaattgtttgggcaatgttttgcggctaaacggccagaagcggcttccaatgccgccacccataatcacgcaataattatcctggtttgtcatgatagtgactctattttaaagtttctgctaatgtacggtttattctctgaatagagaagtgtttaagatatgttttattatttttttctccttttttttgccaaactattgtggattcaaaataatgtcgtatctttgcaccgcaattgagaaatcaagtatgcgcccagatggcggaatcggtagacgcgctggtctcaaacaccagtggattcacttccatcccggttcgaccccgggtctgggtacgaagataaaagctaagtaattgataattcaatgcttagctttttcttttgcctaaattttccccacattttccccacacgtgcaaaaaatatagcagtaagtcattatttcttttggttgaacgtagtaaatcagttacctttgaaaagaaataaagcctattaaataaaagtaatggaacaaggtgtttggcaagaaatagaactgttgtaccagaagtttcacaaacttggtatcagtgaagcggtggactatgacaagtactacctttattctctcattgcccattccacagccatagaaggctcaacgttgaccgagcttgatacgcagcttctctttgacgagggagtaacagcgaaagggaaaccgcttgtgcatcatctgatgaatgaagatttgaagcaagcgtatgaacttgccaaaactgaatcaggcagtcttgtacctataactcctgcttttctgaaaaggttgaatgcaatgttgatgcgtactactggcagtgttcacagtgtgttgggcggctcttttgattcttctaaaggagagttccgtctatgtggtgttacggctggtgttggtggacattcttatatgaactatttgaaagttcctgctaaggtggatgagctttgtgcgattcttcaagagaagcaaaagaaaatgggaacatttcgggaacaatacgaattgagctttaatgcccaccttaatttagtaactattcatccgtgggtggacggcaacggaagaacggctcgattactgatgaactacatccaattttgctatcacctttttccgaccaaaatatttaaagaagatagagaagaatatattctttccctgcgccaatgtcagaatgaagaaactaatcagccgttcttagactttatggcaaggcagttgaagaaatcactttctatagaaattgaacgattcaatgtatcacgaaagaaagggtttagttttatgttctgatactatataaaacaagaattgctatttatgagtttatggtaaacttgcatgtgggaaagtttgaacatccatagaaagtgccgtacttgcctttcctcaaaatgagatgtcctccgcattgaggacaaacaccttgatttattaggcgtgaacttctgtattgccgagcctttgcgttatgcttatgctgttttagtttctctttatcagcaattatgcgattctggttaattgtctgtattatccaatttatggtctcctgattaagaacagcagttctgtattgtaatatagcacgttttagattatatctgtttacaactatgttattgtcagtatgcacttttaattccgcactgttattgaaaacgacaattggaataaaaagtatatccgttgagcatttgagcaaatgatgcaaaaatcttacatgtccagcgttttgttttatcggattgtaaaattgatgtttacttttatagatggtttgcgtccagtattcactgttctctccacccaaaatccaacctttatatccctttgtttcaattacaaagacaccataaggtgaaactacaatatggtcaatttgcgttgaatatccgttactctcgaatagtaaatcattaaaaacaacatactcttctggtaactcttgaatcttgttattcacaagtttttcagaatacttgcctttccacactggcatcttcaatttaataaagattaccactgcaaaaaagacaacgatgccgacaatatgcatattactgatttaatagattctttttatccatcttttacttgattcaaatccccattgaacatgccatcttcttcctgttactttatctaacaaaagaaattgatatatattttttgtgggatataattcaaatgttccacagcctgtaccaagagataggtcttcgtcattaagagttgcagaaccttctttatcatcatccaaagaccattgtacaatttctattttccctgtcattgtatctaattgcagaaaattatagatattttctgttggatatagtttgtacctatcaagtccatgcatacgaaaatctatatcttctacaatagcatgtattttaatcaaagtagaatcattaactgttttggcatgtgacatagaactttcgttttgtgcagaaacacataacggaattaaaaataaataaaaaataatcgtaagtttcttcataggtaaatcatttaagtgattaaaattaagtgtaatagtatagcaatgctgtatttatttcttcctatttacatcccatttaaaagtataaatataatctccgataggaatgtttacaatcaaaatcttaccttttttccttttaatattcatatagccaataatagcttcatcgggataaatagttgtggtttttaaatatccttgttcacgtatagttcggtcattatccatcatttgtcctaatgtaatcatttgattggtagatgcgacatttgcttggtatgctgcattagcgtcataatgattggttatggttgtgtaagcataaccattagaagaataagacgttgaataggatgttgaatatcctgctgttcctgcattaatgccagcagagattccatataatgccatagcccatgcttgtgagcgttttatttttttttgatattcttcatttgtatatacttcaagttttaaagtatcgtctttttttgttagtagattagagtgtacgctgtcaggttggaatacaattggggtttcacttaaattcttgataaaaatatccaagtgatagtatttcccataatcatctttttcttcaaagcatgaaagacctacaacaaaatcatttttgtttaaataagcccaaaatttcccatcattatattctgtcaggatagaatcgttttgggggtatatgaatgtttgggctttacatgtggttgaaagcaataaaaatataactacacatatattctgtttcatatcaactaactgttttaattatacacctccagctaccacaaggactttataatatcacgaagcgtggaactgtaatgccacctctttgaatgaaggtcctgagaaaacctttgtgtacagatgtaacaatagcagcccacgctatagcgtgagaaccactatgctattcttgtacacgtttgaaagtttctcaggttttcattcgcaagaaataagcataacgcttcttctaaattctaatatgtcttggaaagagtagcctcaatccgcttacaaagatatgcaattttattgaggtacaatcaaatactatcaagattacattctgaatcctctactttttcttggttcttctgctgattgttgcaaaccatgtcttaatttctcccattgctccttgaaccattcgcctatcggctgcctgtttatggtcagtacaagtttgctatcatcggtcggatttttctctatcttgaagatgtcgtttttgatttcaaactttcttctgtgttcctcggaataaatcttaccattgcatctgatagcttcctttttggtcaaaagactgtttaccatatctttggtaaatccgatggcatagcagagcttttccattcttaacatttctttgagcaatggaaaccagttgaatgctttttcaagaatggtgttcaatcgtgatatttccttggatttggcttcaagctcttgattatgtattccttgtatgttacgaatctgcttaccatgctgttcctgcatttgttgcatcttggcttttaattcatcaatgcccttgtcacgtttggcaatttcatgacgtaaattctcgttagattgttccaaatctttcaatttaccgctgtcgaaaagagaaccgacaccgcttgctatggctgtggctgcatcagtggctacacttttgagcttgtctgtgcgtatctctgcttttacctgtttgagttcctgctcggcaaggcttacctgttgcttcttgtgtcgcttggtttcctctatacgttgcagttcagctttctgtttttcaatgataaagtcgtttcgctctaaatgttctttgccagtgatagcctttgcctgcccacgttccatcaggagaatatcggaagcgagggtttgcatggttgccatatcctcgtcattgagctttcggctctttccggtttcatggttcatccagtcgaatacgacatgagcatgataatttggtttgaaccatctgttaccgacttggaagctctctttgtcttccgcttccggctgaccgtttagccaatgcccttcgtctttgtgcaggaaaacttgtagtggagtgatgccccaacgtctttgacactcttcaccgaatttgcgtacatcagccagtgtggtgtccggtctgataagcaatactccttcacggatgggtgaacatcccgccaccttgataatctttccattctttcccttgcgttccctttccttttcctgcatggcacgtccggtcttttccttgaccatttgcttgatattgtcataatgagttcgtagttcaggagtgccgaagtcgggatttatccactgttcgttatcggtggaaagttcgggaacgacatagattctggactccccgatattacgcatatactcggcagtccttcggttgtgcgcctcgctcgatgcgatgttgcaaggcttgatatgtatgcttgattttgttgccatagcttcttttctttgtttgcaattgattattttgctcgcttttgcagaggggttcttaggggtaacccataagcggagattgcaaagagagggtcactctttgctcggggttctcaggggtgaaacgccttgagtgggtcattagggcaaagccctaatcccctcgggagagcccacaactacgaaagcggagcgtgtagttatagtgggctataaccgaaagccgtttttctttttcggtgactggctgctcactcctttaacggattggacttgcctttttctttcaacctgtttctgtaagtattcgttcaagtccttacatccgctgtaagtctgtgaagcgtcacggacatatcggtctctgccatattccttgcggatttgttggagggcttccatgcctgcatggtcgttgtcgaaaaagcagtggatgcgttcgtagttgcccaacggatagagagccttgttcacattcgatacagaattcaatacaatgtagtcctgtccgtccagctccggataattcgggcagttctcttgtctcaatgtcaaaaaggagaggtagtccataaatccctcgaatatataacaggtatttctcgctttccccgattgtctgatgtgggagatttctttaggagcgatacagcccttgaaatagcggttgcggatttcatatccatccgatacattgggaaaggcgatggcaaaataccgcttgccgttgtgggtgaaacgtgcttcactacattctcttttcgccagttctatgttaattcctctaccttgtaagtaggcaagcagggcaggggaggataaaggaacaatctccagatgttggaagctcggctcggaagagttttgcttgccaaaagagaaagataccgggcgcacgtgcggtgtctgttccgctatccgtttcaagatgtaaggtacatggtcggtagcgtacagatgtgcagccagtgaaatgatgtttccgccctttcccaaaccgaagtcataccattgttcgcgttcggtattcactttgaacgatgcttcactctcttcccgaaacggggatttgtaccaaaggtttattccttgttgttttactggtgaatagcccaagctgtatagatagtcggctattcgtatgcttttagcttcttctattgtcattttcttacggatttgttggtgaatgaaaaaatgatgatttgatgaatttggaatttaacacactgttaaacagcgctatattggttcatctttttctcatcagattgcttgccaaaagagaaatgatgttttcttttttcatcagcaatcgttgttgatgagtgtttgatgaatatctatttgtctgtaatgcaatatattactgccctttttcatcatttcatcaaaataattagatagcggtcagttgttctttcgttaccgtataaaaccgaccagttttccttttcggatcatagtggcactcacgatggggtgcgaactcataagcggtgtaggatagcgaattgtgtgcggaagtgagtttccatacttcctgcacaactttcctcacttgatacttttcaaccttgacctgtgaatagagtagcaaggttacaaggtcgttcaggcagaatgatacgctttccacgttcatgttcgacatgatgtcaagtaacaattcggtcatttctatttccagtcggttacggttgcttcggataatcttttgcaaggctgcggtatgtgtcagtcttgggttgaaccacatacggctttcctgtgttgtggatagttccctttgggtcaggaaataaagaaatgcgggtatttccgcttttagcttttgcagaaagttggtatcatcgttctgtaatggcattatcttccgcacccagtagcgtgtttctcctgcgtctatgagtatgggcagatattcgttgttggaacataacacgaacttggcaaagaaagcaatctccgttcggtctttacctttggcttccactttgtaggtgaaagtggtgctcaggtttttcaaccgttcgctgtcttccctgcggttgagcaaaacttcgtccacaacgattagcagctttcctgcccagtcggaattgaactggctgcggaaatcctcgttggtgttgaatgttacgttattctcaaacacggctttcaggaagttcaagaacgtacttttgccagtattgcgttcctctgaaacaagtaggacaatgggcagcttctgtgtcggctgtagatacagcagttgcatatagtccatacccagctcatattgttccccgaagatgtgccgcatcaaggattggatgtgggagaagtccccctgctgcggtttatgatctatcggctcgtaaaggttcagaaacccctcaatctccttttggtagttcagatgattgggaacggtgcaaaagccgtcatacttggggacggtggcaagatagttctttccataatcctgccgtaatgtgctgttgttccatacgacacgtttcttttcataaccgccattggcgcatggctgattgaccaccttgtacaaagttgttcctacgcgcatatattcttcctccttcataggcttagattaaagggttgtgttcacctaagattctctgaatgtcggattgtcggtatctgaccttgtttccaacctttacaggcttcaggtagtttttcttagaccagtgccagagtgtggtatcacaaacaccgcacatctttttcacttcctctttagtgaggtacttctcctttcttgcttccgcaatagcggtagaaagttcatgcttcgcacggctgattaactggttggagaataatagcaaatcttctcctgttacttccaacttgatgttgccgttcccgttttggataattgtcaataagtctgtcataggcttcttgaaactgccggttgtaagacttcccgtttcggcagtattataaacgaaaagccactaccccgattaggatagtggcgcaaatatataatgaaaatcaatcgtaaaacaatgatattcaatttgttaaattcgtaaaaacgaaaagcgaattaaacgaatttcaattggatagataagctttcaattcatctatggctattcggtcttcaccaatgtctttcattaattttttgctggttccgtatggtgaaattaagtggctgtatgctttttggatgcctctctcttgaactatttttaattcttcaaactgattttgtagtgcgtttctgaaagttttcattgggcattgtcgcataaagcgatattccaccaatgcaatataaaggcgtgcaatatctgtatctgtggatttggtctttagccttgcgcctattttttctataaacacgtcttgattttctatcaatagttcaggcagtgtacgtgtgtctgctttacgtcctgctgtcttaggtgttttttctggagtggcttcttctgtttgtgtatcatcgtttttttcaatgtggttttcttcttcatcttcgatagaccattcgataagagtgttttcctcaatggctttctgttgctttctgaaatttagccagtcctcttttgtcctcatgccagtggatatactctttcttataataaatttgaccatacacgaaaccaaccatttgtataattttccaatatcctttcttttggtcagttcttccccttgctccaccatgcactcgtaacttcgtccatagtatagccatgcaagcatagcaggtactatgcttctcttgtttgggttgtggaactcgctcacaatcttttcggcaagatttgattccaataaaatgttttccagtttttcaaagtcgggattcctttcatcgcttattcttttgtcggcaacttgcctgtatttcggtacaagtcttgtcgctacattgaaaaccttgaagaaacctttgaactttttgtcgttcatttcttctacgaaatcggcatattcattaggatggctgtcaagccattcctttatcagtcttttgaaattgtcatattcttgttgtcccatacaagttaattagcaatgcaacctctattaactttctcttgtatgcgtgagaaatgtatcgacaatttgaatattaacatatagaaaccataatcgcttaaagaaaataagcgttgatcttctaatgtgtctcggtttataaagcgattgtcaacgtgatagattttatcaagaaaaactattgaatcttccatttgggaatttgcaggaagaaagattatttgggttattttttgttgtttgagatttgaaatgtggttttcaattttgctactattaataccttgtttttgaagaactgaaatatattttgtgagatttataataggagcatacatgattgaggcaggaaacatacgagaattagataaatccatatcacaagtgtttgataaaatcaaacagcttaccttttttacacctctttcgatattagttaaatcaattataggcattttttttaagccatctccttgaaaaatgacattcttgtcaagcatagaagtgtacatccttccatctatgttataagggaaagatttgagttctgccaaaagggtcttgtaattttcttctgacaaatatttgggtagatatttttttaattcatcttctgtaatcatagcatatcccaaaagtggtcattaatgacattttgaatttcttcatctataggagccgcttccgttaacatcttattcgcaaaagaattgattatctcaaaatcttcatgctcgggaatattaacatgaatggtctctgttgagataggaatgtccttaatggaataatttgtataaatatttattggattgacaggagtgttaatagacggtattatagcatcattatatgtttgcctacttgataaagaaagcaattctgtatctgttaatgtcatacatgataaggcagacattaataggatattggtatttatgtaagtcgttaaactattcattttcaaaaacaggttttagactatttaggaagttaggttttaacaaagagaaaaacagctttttttcgcaattatgagccatatttatttcttgttctatattagaagtgaaatagttgtcggaatattcacgagatgtatcaatgtcaattaatgaacctaccacttctatagaattagggtgtggtttgtagtttgcattatttacaaattgtagggtgttcataaaattaccatctttgacatctgtccgtatcaataagttttcggatgtgtatttttctgtcatggaaaaagacatcgtaagactattggtaatatctcctttgaagaaattaatatatctatgtcctattcttgatacacgctttattattccggaactaataaccttgttgattattgaaaatgaatgtttagaaaaatcgctccaacctatatatggcatttttgagcttatgctcaaaacatcatatcctatttgaattacaaatctttcgttttcaattctgtataggggcttaaattttaagttagggtcaacctccctaatttgttctggaatctgtaaaatgggcaaattaatgacatttcctctatactcttcttttatgagattgtatatgatgccaaaaactgcgcttttggtaatagctgcttcaaaacggaactcaattaaagcgtctataagtgggcatgcttctattcttattggcaacaatctatccataatacaaattttaaatctattttcttgcaaagttaggaatttcttttatttatatcttgattttatacgctaaaaagtttaaagtatattaatctaatagtttcacaaggtcttttttcatttcttcgtcaatgtctctgtatcgcctgaaggctttgcttccctctttgtgtcccgacagtgcggaaacaaggttggggtctttcacctttttatagatgttgccgataaaagtacgtcttgccaaatggctgcttgccacttcataaatcggtcgtttgacttcgttgtgtgtcaacgggtctaagatagtcacgattcggtcaaccccagccaatctgaatatcttttttatggcatcgttgtacttttgttcggatatgaacggtaacagtttttctttatattctttatagcgttcaaggatttcttttgccttatcattaagagggacacgtaccgtaaccggatttccttcttttgttttcttgggaatgtattctatggcttcattaaccacatttagtttggtcatacggtataggtcgctcactcgacagcctatcagtgtttggaatataaatatatctctctgtattgccagttgtggggtagctgaaaggtcggcattgaaaattctatccctctcttcaagtgttatataataaggtgtaccgtatgtacattcttctatcgggaatttgtcaaaaggtctgtttgtggtacgcttgttatcgaagcaccacaggaagaatgtgcgtattcttgaaaaacagtctatcagcgtgttcttgcttctgggctgtggtgtcctcttttcgggaatggtttcataaatgctcgggtaaagttcatagtactggtattcgttctgaaagaagtcccacatatcccgaagcgtgtcaggcgttaccaaatccacgtcaaggataaagcccttttgtcctctctttgttgcccttacatatagttcataacgcagtaaggctcttttgacaacccggaaattcttctttcgtacttccgacaaagggtgtttgtttagaaattcatcgaatagttctccaatggtaggcttgataaccacttcctccggcagaaaatatttttcaggatggtaaaatttatcaagtgttgtttttaaccattctttgtctattgcttccttttcttgttgatataccttctcaatataggttttcaactggcgtatctcttcatttataagggtacgcatttcttcattgcagacagctttcgtttttacacattcgtctttatcatcccatagattgggattgatagccaactgagtaggagcaacggagtctaactgccttccgtttctaaagcgtacatagattgtagccatggattctgtatcatatcgcttggctgcttttttaatgataaaggttactttcatagacttgcaggttgaattttactctgctgcaaatatagatattttccccacactttccccacatctgctgaatattttgcaattcgattaacttgaattaaaatttaattggattgtaacctgttgaaacatagtgtaattgtagtgtttttctgcatttttctttttacccacattttcctcactttaattatttcaaatgcgggtctgggtacgaataaatcctgataatcacctgattatcaggattttctgcttttatagggcgtactaaatgtgtactgaatgacgaatacaaagaaaaggtgtactttaatagttttcttccccatatctttatgatttcttaacgcttatcctatctttatctaccttattattgccgatgttttcgggaaaagtgagattcttaccttatatttgtagtaagaacgtttaaaggcgcacgattatggaaaatcatatggaaaacaatttcagagaaatacagaagatattagatagttgtatagctcatgactataaaactaaagtagatgcactatttttaaaacgtgaatatttgacgcaagctcagctaaaggattatttgcggcaagaaattttccgtgtgactgaaaatattgtagccatccaacaaaaataccgtgtcgtgcgtaacattgtattggatatggatattcccgattttttgtgggaaagcggttattttgaggacttgaattctgatgaaagaaaaaagtatatcggtttccgctgctctgattttgatatggacgcatatttgcatgaaccgtcctgttatgatgggcggcttccctatttgtccattatcgttagtcttgtcgtgctttccaagtatttgcgctatctgcaagaacaggaaagcaattaccatacagatgcggttgccatccaagagcaagtcttgccaaaagagaaagaggaaagtgcagatactaatccaaccaagattgtgggcaaaagcaatcctttcaagtccacgttgaaagccaatgaaatcaaacttctgaccgactgtgtgaatgaagcgaatatgtttactactaccgtcagtgccaaaatacttaccgattttttcaactgcaaactgaatggggtattgaaagttaataatacccgtctgttagcctatcttatgatgcagcttggctgctataattacattgtttatgaatggcagtctgtcatagcaaataacaagctgatattaggaaagataaaaggagaaccacttacacgtactgacttatccagtgcaacagaccaagcaaaaaacatctatccgaaaggatatgaaatcatagacaagtacatcaaacaactgaaaaaaggttgagcatagattgaacgctcaaacaaaggtcaattagacttcattttcaacctcttaactttgcccccgttaacaaaaaaaacgagggtgcgcaccttcatattgtttcacctaaattcctaaacaatatggaaagagatttagagttaagagtttcagaactcgaaaaattagtgttcctttcaaagaatgtgcttagcttcgatgaagcgagcaggttcttgaacctttctaaaagttacctgtacaagttgacttcgggtaacttgataccccattacaagccgcagggcaaaatgctttattttgagaaagcggagttggaagcatggttgcgtcagaacccggtcaagacgcaggcacagatagagcaggaagcgcagaaatatatccttaaccgtcctctaaagaaataacggttatggaaaatagaaaagcgacagaagctgggcaggacgtcactatgcagaaagaggatttcgcagttctttggaaaaccattcatctaaaggtgacggacacttacgaagtaccgcccgaaatactctgggtgaacggctctaccattggcacgctgggtaatttcagtgcatccacgggtaaagccaagagcaaaaagacattcaacatttccgctatcgttgcggcagcgttgaagaatgacgaagtactgaagtattcggcatacctgccaccgaacaaacggaaaatcctctatgtcgatacagagcagagtaaataccattgccacaaggtcatggagcgtattttacgacttgccggactgcctaccgacaaggacagagacgattttgttttcatcgtgctaagggagcagacacccgacaagcggaaacagattatcggctatatgcttgaaaatatgcccgatgtggggttactcattattgacggaatccgtgacttgatgtatgacatcaacagccccagtgaatcgactgacctaatcaacctcttgatgcgctggtcaagcggatataacctgcatatccatactgtactgcatttgaacaagggggatgacaacacaaggggacatattggtacggagctgaacaacaaggctgaaaccgtcctgcaaatcacgaaaagccagcaggacggcaacataagcgaggtaaaggcgatgcacatacgtgaccgggaatttgacccgttcgcatttcgtatcaatgacaacgctttgcccgaaatcgtggatgattatgtattccaacaacctaagcaagacaggaattttccgcttacggaactgactgaacagcaacaccgggaagcgttggagaacggtttcggcaagcaggtggtacaaggctattccaatgtcatagcggcattgaagcagggttatgcgagtatcggctacgagcgtggacgcaatgtccttgtgtcacttaacaagtttcttgtgaacaagcgcatgattgtgaaagagggcaagggctaccgatataatcccgatttccattattaaaagtcagtttggtttagtccgggtgtatatataagaggaacggacttactatttccctgtttcggaacaagcaggtttagtatggtacgggtatatatataacggactaaacaggactggcgcacttttcaactattttttaatccccaaaaaagaaaatgttatgaacatcgaagatgtgaaacaaatacccatcgcagactatctgcacagtttaggttactctcctgtcaagcagcagggcaacggcttatggtacaaatcaccgttaagggaggaacacgaaccgtctttcaaggtgaacactgaccgcaatctttggtatgactttggagcaggcaagggcggcaacattattgcactggcaaaggaactctattgctccggcagcctgccataccttttaaaccggatagcggaacagacaccgcacgtccgcccggtcagtttttcttttccccagcgtaggacagaaccgagtttccaacatttggaagtccgtgacttgacccatccggcattgctccgttacttgcaggggcggggtatcaatatcgaactggcaaaaagagaatgtaaggaactccattttaccaataacggcagaccgttctttgctatcggtttcccgaatatggcaggaggttacgaggttcgcaattcctttttcaaaggctgcatcgccccgaaagacatcacccatatacggcagcagggagagccgagagagaaatgtttggtattcgagggttttatggactatctttctttcctcacgctccgaatgaagaactgcccgactatgctcgaccttgacaggcaggattatgtcatactcaactctactgtcaatgtgccgaaagccattgacgtgctgtacccatatgaacgcatccactgtatgcttgacaatgacgagacggggtataaggcgacacaggctattgcattggaatactcctaccatgtgcgtgacttctcggacaattataggggctattcagacttgaacgattacctgtgcggcaagaagcaggaacagaagaacagcacctaccaagcgcaggagataaagcaggaaaccggacaacgtgccgccccaagacagaaaaggggcagggggatttagtccggcaggattaccagcggcaggcggtttgatttggagagcaaggttatgtttcggtaaaccgaaactacctttctttgcttgacagcaaagaaaatttctcccgttggtcgcaatttttaagacaccatttaaacgtaaaaacctatgacgaatataaaggataagccggggggacgtccggcaaagaaacggatagagaagcagcaacgggttgtcagtacgaaactgaccgagttgcagtattacgccatcagaaagagagccggagaagccgggttgcgtgtcagtgagtatgtccggcaggcagttgtttcggcagaggtcataccccggctgaataggcaggatgcggacaccatccgcaagctggcaggggaagccaacaacatcaaccaactggcacaccgggcaaatgccggaggtttcgcactggtggcggtggaactggtgaaactgaaaaacaggattgtcgaaattataaaccagttgtcggatgattggaaaaataaaaaagggaagcgggtttaagggctgcgtaaactatgtgttaggcaaggaacaggcggctttgctccatgcggacggggtactgacagaaagtcggggagatataatccgcagcttctatatgcagaccgggatgaatcccgacttgaaaaagccagtcggacatattgcgttaagctattcggcagtggatgcacccaaattgacagacgagaagatgatacagcttgcgcaggagtatatgcgtgaaatgaaaatcaccgatacgcagtatatcatcgtgcgccatcaagaccgggaacacccacatgtgcatatcgtattcaaccgtattgacaacaacggcaagactatttcggacaggaacgatatgtaccgtaacgaacaagtatgcaagaagctgaaagccaaacacgggctttatttcgctggtggaaaagaacaggtaaagcagcaccgcttgaaagagccggacaaatcgaaatacgagatttacaacgctgtaaagaatgaaatcggaaagtccaagaactggcagcagttacaggaacggttagcggaaaagggtattactatcctgttcaagtataaggggcagacgggcgagatacagggcgtttccttttccaaaggcgaatacacgttcaagggttcggaaatagaccgtaatttcagtttctccaaactggataaatgttttggggatgtagggcaggcgatagtcggaagcaataagcagacggttactgcacctattcagaaatcagtatcagcatccgacaaagcggataattcttttattgcaggtttagacggtctgttttccggtttgtcagccccggctgatgaaatacccgatgattcctttttgagaaagaagaagaaaaagaaaaaacaacttaaactgtaaatacatggaggaaaatttgattttagaggggcttctctcaatggttacagaactgaaagagaagcaggaaacacaggtgacgccagccagtcgggaggaaactctcgaaagactgaacgcaatcgaacaggcattgtcggaactgcacagcaacccggctattctcgaaaaagatttgcaggctattcgaagccaacttgacgacataagaaacgggatgcaaggtcagcagaaacatatcgaggacaccaagaaaatagcattggaaacttatcgttgtttcaaggtaatgattgatgctttgggttcttgcaagacggataaaaaagaagctacgcccttaccgctctatcaacggatttacaacaaggtagcttcttggatttgtccgggattgtttcttttttcggcagtgctggttatctgtttcgtttccatattcttgaatgttcgtttggctgaacgtatgcagcagttgcaggacaacgatatgaaataccgctatttactgatgcaaagacaggcagacggggaaacttttgatatgctggaaaacaagttcaagtggcaacgggataacgattttatccgaagtctgaccgattcagtgatagattttgaataccacatccaaaagcaagcggaagcactggaacgtgcaaggctgttgaacgaacaagccgagcaactaaagaaagaagccgataagttgggtaagccataaacagagaaagccggaacggatgaagcacattcaccgtttcggctgttttaattcacttctttttcttcgtgcagtgttctttttcgaactggcgtagcgtggtaatactgaacctttctttaataaactctcggacatcggaagccttgtaatacacttttccgctgattgtgaagtatggcagcacaccgatagcccggtaacgttgaagggttttgatacttactttgaacaacagacacaaatcttgattatccaacaggttatcatcttcgggcagcaccttatcggcgttacgcaacacccgtacatctttgcagagttcttccagtttggcatacaacttctgcatccattcgccaaatttatcattctctatatacataattgcttcatatttcagattatacctcttgtgaattgatgaagcaaaattcagaaaaagaatgcaagaaaattacgggggcgcacatggaatccattataaataaatcataaagcactgattatctatatccttttttgtcatgttcctttcggataaggtctgccagtccattaagaaattctgtgagtttgcccggctttcgttttatcacgtcctcatgcttttggtgacagtcgcttatcttgatgttaaacaaccattcaaaacctttggataaatctaccaaataggcaggtttgccgttctgataaacaatgtctttggagaggaacagaccgcttaccatttccatgatgttgataagggctgttttgtcagcgagatagagaggggaaaggctttgtttttcaatccgctgtttgagttgttccggatatttgatgcaccattcaataaggcgtatttctgtgtttaaaagtcctatcgcttcatcaattagatgcaaataaggcatttttttcttgctcaaaccgtacacggtatgacttaagacgatataaaccaaaagaaaaatagcggagtaatacactataatcttgctcgttaatactgaaattggctacatggatagctaattcttcaacagcttttgttagttcagatgcagaaactttgcgctgtgagtattccgatagtaatcgaaaaaaactctgttgtaataatgctttcatctattaatatttttaatttcataattagttagttcgtcttttatagaattttacttatatcattgggtgtcttaaaataatagtctgcacgtataggattagatacattattgctccataaaaccaatccggaatcaacaccggcattgttagcacattgaatatcataaatgctatcaccaatatagagagcgttttcggggcttacatgggctttagccaaatatgctactaagggtgctgcttggggcttatgttcatcagtatcatcggcacatacaattgtggaaaaatagtccgctaaccctaatggctcaaaatcagaataatattcttgatatgttttggaggttacaatgcctaaaatatagcctcttgataaaagggattgcaagcattctttgataccttgaaaaggttgaatagtgtgctggagcaatttcatattcctatcccatcgtttcaatgcatcttctatgtcgggtattttgagtaattccaacgcatttcttccggtaatgcctaaagcaaatttcagactttcatattgaggtgcgcttcctgttatttctgtaattgtttttattaaagagttgatgactgcatattccgtatctatcaatgtaccgtctatgtcgaatacgatatgtttatatttcatgtgttgatttattagtcaaataatacttgccagtttctatcgtagtaagctgaaaagcacattttaatttgttcttcgttatttttctcttttgcaagaataggtaattcttccaatccgaaatagacactctcatccgtttcaatattgggtcggaaatatccgctttcaatctcacaaagaacaaaaactttacaaacattgtaggcataggggggaatattatgcaaatttctatcttgtatagctattatccggatagcttttacatttaatcctgcttcttcttttacttctttttctgtattagtcttgatactctgatttatatcgacccaaccaccgggcaaagaccaagttccatttttctctttcacaagcagtattttatcatctttgaatatagcagctcgtgtatctaatttaggagtttgaaatcctgtttcattgcaaaacagattctttactttttctatgggtatttcactttgcagactaagcatttctgctgcaatttctctaatgcgttcaaagcgttctatatcaaatacatctttggagtatgtcaatcccccttgggcaatgaattgtagttcttttgcccattcaagccattgtggttgtactattttattcatatagtgaatgttagtatcgttatattgatttacaaaggtatggaaaatgaaattctttatttttgtcctatgttaaaaaatcatcggcttgaccggattctgctaagagaaggttgtgttattcctaaaaaagaggcaatatgtcctaaagtcactcggtggaaaatgctgggatattcttttatcaacttttcataacgttcttgggcagacaagttcagccgggaaatatgaatgtcctgtaaaagtagaaaattttcttgctgtaacactctcatccaattggcaatgtcaatacgggatttatataaatcattcaacttgtctatagaaatggagtaggttaaagtttcttctaaggtttctacatattcaaatcctgctttgtgccgatataaatcccatgaaccacaagtcgcatcgccttccatagaaaaccatgttgttatttcttttccattatgcaggatatatgaacgtgttattcctttttctatgaaatagacttgattgtcaaaacgaccagcttgtatgatgatagttttagctggaaaagtctgttgtttgaaacagtactttagcagatgcaatgaatcatccgaaacaggatagagttcttgtatctttcttattatattatccattatcaatgtttttgctctttctacaaaaataataaaacagaaagggataatattgttgcattcatagtttaaaaaggaatttgactatttttagcaaggtgggatgaaaagagaaccacgatgtggatatgtgatataggcaaaagaaataggtggtgctaaactacgtttagtttatccctttgtctatatagccaaaacgaactaaaccaatttctattgacagctagaaacgatactggcgaaaaaagaaatagtattacctttttcgccagtatcgtttttagcaatctttttcagtcttgatttatccttaatagtttgaggaagaaatgaactcttttatttcttcctcggttggaagttctatcatgtacttctgtacaaagatattcgggtctaatccggcagtggcatatttaactaatgtatctcccttttcggtgcagagcaaaatgccgataggcggattatcatccgactgcatcacttctgctttaaagtagttgaggtacatatttaactgtgaagcatattcatggcggaacttgtctatctttaattccacaataacatggcatttcaaaatacggtgatagaacacaaggtcagtaaagaaataatcttcatcaatcaagatacgtttttgccgggcttcaaagcagaagccatgtcccatttctaacaggaagcgttgcagattgtcaagaatggattgctccaaatcgttttctgtcactaatgcacgttcattcaaccctaagaattccaaagtaacaggggtattaattacatctttgggctgtaataaggttgcttgttgttggactaaagcggagagtgcttctttgtttttggatagtccgctacgttcgtaatataaagacgctatttgtcgctccaactcctttacagaccagcaaccacgcatagtttccatttcatagaaagcacgttttaccgggttttcaattcccgatatggtatttaaatgggtggaagataatctgttgaataatctatcagccggaatcatccatgtttcggtttgtgggtgttctgttgatagtttccaaacgccattttcagattcggcggtcaccaaccgccgaattggttcggtgaattcggcggtcaacgactgccgaatttgtatttgtgatgcaatatattgtgtgacagactcttttagctgtggataaacaagatataaccgcctaaattcacggaatctacgttcattcagaccttttgttttcagccgttgttccagcttcttcaacaattgttcaccgtatgcggcacggtcttctccgttctgctcaaactctacgatatagcaacccataagccagttacgggaagtaagggcaaggtttacagcgtgtgcagcttgtacctgcaacgtgttctgtatcgtattgatatgttttactaatgcttcaaagtccatagttacaaagataagtcttttatggttaaaactttagttcgggcaagctgtttattgcttcctcttttaatttatccaccgcacgggtgtacttctccgtatgctttaatccgctatgtcctaaaaggctggctacggttttgatatttgccccattattcagaatgttcacggcaaacgaatgtcgggcacaatgccagcttatatgtttgtctatcccagctctctttacccaacgctttactgatttacagcagctttcgtatgtaggtaaatcgaatatcaaacagttcttgtctgccggagcttcgccaataatggataatagaccatcattcaagggaataactacaccgctactggcagaatgccccttggtcttgctttgctcgaacttcaataatcggttagcatagtccacatttttataagtaaggtcttttacatcgcagaaacgcagcccacaatacagacagaagacaaaagcccgtctgacattcggattttcattatcgtaatggcaagctaccaatttttgtatttcttcgggagaaagcacatctttccgaagcatttgactatctactttgcaggtaacacttttgcacgggtctttcaacattacatcgtgttcaatcgcatatcgaataactttcttgaaacgctggtaaatgcttttagcaccctcacccacacttcgggattgcaggtaggttacaaactgctccatcatttctttggtgataagttccggtttgatactaaactcattcatggggtactgctcttttaagaaatccttaaaacggctaagcgcaatttgtaccatgcgaatatctttcttggtataactgttgatataagcttggaaatagtctaagaaattgaccgttctatcttttttcaaccgataccccaacatactttccttaaattcctgttcacgctctgcacgtatctttgtggcaagctccaacgtttctttgttctgctgacgttccgcaggggtacggggcttatctatcagatacagactaaggttttcttttcgcctgttgtgctttactgcaaacttgggcttgccttgcatctttccactatcatagtacacttgattgccgttttcatctaatacgggcttttcctctctacctaaataatactctaagtaaaggctaattctcccgtccgagagcttattttgctccaatttcggattttctttcgttttattttctatctttgccatactttactggtttcatcccgattcgggtacataatcgggaatatctgttaagtgattgattttcttttgttttctgatattgcaaaggtacaaaagaaaatgagaattcaaagtgtactaatagtgtactaagtaacaaaataagggtataaaatggcaaaaacagagaataaaggaagatgcaaatcgtttgataatcaaatgattgatttcttttgttttcctatgatttcggtgctttgtaccgggtctgggtactgaagcggagaaagtagaaatactctctccgtttttcttttctactcctcgtaaattgttggtcataccgaaattcggatcaatataaaatcaaagcgggataaaaaataaggtaaaatgtaatattaagaaatgatgattgataaactggatttattatcaaaagatgaactaaaggaactggtcagaatatacgcaagaaacatctatgcacttgatggagtatggtttcaatccgtagaaggaaagaacggtatggatgaagctatgttgcacgatgaaaatgcatggagaaaattcacccgtacggaagcccggagaatcaagaaatttctggaacttcctgaacaggcaggactcgaaggactggagaaagcattagcgatcagattttctgcattgtcgaatccttcggtaagccttttcaaggaaggagattctcttatatatcgtatcaatgaatgcagggtgcagactgcccgaaagaataaaggcatgccgtttcatccttgtgcgtcgcctggttttatcgagcatgatggatttgcacgcgtcatagacgaaagaatcgttactgaaatgattagctgttatccgaatgttactgatccggagtgtgcttgttgttggaaattcacattaaggtagtaattcaaattctccataagccactttggtgcctctgttgaatgatttgtagatacggtatttccctggatggttgggggattctgatgtatagagtttaattgtttgttggtgacttgggtgctctggtgggaaaacccacagtatatcattaacgacaggatcggtcggcaatgtttcccattgccgtttacttttgttatagtaagcaaggctgtatttttctccgcactcatattcatagtgagagtggttggtgatggttatttttacttctgtagttgatagcggataatgatcgtgttctgtttctatagaaagcgaagcgggacttatgtcctctccagtcggaatgtcacggggaataggtcgcaatatgacagagttcgtttgcgatgactggttagttttcttaggtaacactgtataaagcccttgttcgtcttttattatctcatattttcccgatgccagccacgtattccaatccttaaaaaggccggtgataaataggtataaatcttcggaaatatatatttctgtacctgactttaaatcgcataccaactgaccatttacgacagacagatgtttctgggctctttgtaaggctttcaaatagacaacctgattaaatgcgtaatctttattgaaacctcgtcccgtgaataaatctattgcagcatacgacatcgtccctcttgtcttcaggaaagtagtgtcggttatagacgtcttgtatctattcgcttcttcccacatctttcttttttcctgttctctgaatttctgcacaatctcgctcactttatcttgttcgcttatttctctgtgagattttaggctgtcattatcttgtaattcgtcataaagaggtaaagcaaaaaaagtgttattgtccttttcaaactgttctatgatacatgggataattttcttacccatagcttttagctctttgaattggggtaaaatggtgtaagcacgggtacttgaacttaattgtgctttgggattgttgtgtatctctttttcccaggcattaaataaactgtcaaatttggctatatcctctgttgtcaaaatatcacttttttctgtattctgtttaatacatcccgtagtgataaagataaatggcagaataaagaaaagtgttctcatcgttttaattattaatcggttttgtaataggtttgcataagggtatgtcaagcttttgatctgtttcctgcaaatatagaaataatatttctaaaccgataaactggatgctgctgtttttttacgggataagaaaacgtttattcgtttttcgatgtgatactagctgccctttgataaataatgtgaaaaaacagttttaacctcatcatcgaattaactttcacccatttgtgaggtctaacatacataacttatttaatatgagaattaaaatgatgagaaagcaaattttaagtttggcagttgcgttattgattggctcaactgtatgtatggctcaaaatcgtcagaatggaaaggctgatagagagaaacgtatggaacagattgttgccgatctgggcttgaatgaaaagcaggccaaagatttcaaagctgcaatggaagaaatgagacctgcgaaaaataaatcgaatgaaagacctacgcgggaagaaatgcaaaagaaaaggcaggaaatagatgctaaaataaaaagcattctgaccgatgaacaatataagaaataccaagatatgcgtaagaaggataacgcgaagaaaaagaaaaaagcaaaataagtactattcgtttaatctaaacctgtcaaacggagaatcgtaaaagataatctgttatgacgctatacttattttcggttctttcataaataatttatttaatctatatgaccattttcgttctactaaagttgaatgcaggctccatttaaatgagtctatttctcaatttaagtagaacgaaaatttgttagacgatgtttcgtcttatatctatactccctccactaaagcttttctttatgcttttatctttcaatctttcaccttctgctgaaactccctgtctatggtagttgtacgttggtgatagatgtaaaatgatctttcgccgatctgtcatctttcaccggatattttttattgcaaacttatcctcttcccggcttgattcgtattactttgtagaaattaccgcgtttcgtatgcaaagaaggtattttgttcttttgtaatattcttccgaactggacaatactgcagatagatacatgaatcttgctgtcatgttgtagttgttgcagtatttcaatggcaaggagttgctcgcattcttctccttcttttgcccctcggaaatattcgtgaaacaactgttcggcaaccggcatgacttgaaattcctgattattctccgtcatgacattttcatcttccgtgttgaaccaatatcgctctcctctatataagtcgtgcatggcttgtgcataaagctgctcataatcaatgggggagcagtcgatgggaccggtcacgttaatgacgatgtagcgtcggctgccggaagtatcagtcagtaggtccttgtgattgcttgtcccaatgaaagatgcgtatcggcgcatctcttgagtagcggtgccatgcggacgccggacgttgacaaccggtttttgaagaatatgtttcagaaatgcctgctggctcactcggttctggtcaaattcatccatattgatgagtgcgaatctatttagagaaagttcggcatcccgcttattgctgaaatcaatgcggtcggtataataagcctgtaattcaggtggaagtagacttcggcaaaaggtggattttcggtatgcctgcggaccgaccagtaacggtacagtacaattggcgtatttccggtctgtctgacgccagtgggctaccatattcagaaaccagcggtaaaacaagtcaggccagtgggtattgttgcaaggaacccgggttgctagttcccgaatccggtcacgtccgtcccaatggatgtccagcctgaaaaggaaatcttcaataggattgaaaatagggatacggtcggagtccagataccggacgacgtctctgtcccataggttaagcccttccaggcgtgcgttcattgcgatgctgttccgtatgcggttactgatgggacggaaacagaaacaaaacgtgtttcgttcgcggtattccgtaactgtcgtcatcgtattgtagcgaaattcatatcggcgttgcatgaattcttccgtccgaaattccagttcctgttctgctgataagggagatttctttccgaaacctttttcgcacgtatatacattctgtatggtttgccggatcaggaattctttattctttgtatagaaatgggcggtggaccaacggatcgtctcttcttccggtattcctgcctgaaaacagttcttcgctacctgaaccagcaaaggcttcaggtcttcatcggaatgaatatggattcttggctgtaattcgcttagtgattgatatgccttgtttaaagcagcttcgaagagagcggataatgtgtcgaaactgtcatatcccggaatcaaccgtttgaatggagatgcttctgcttgcacagcttccttgtaagttgtttccgaaggcatttccaatggctgccgcatgtaaatcacggtagattcagggttgtaataaagttccgggtcataagtctgtcggcagaactgttccagagcgggattcttcagttcgatagcataggaaagggcgggctggtataggctgaccgctttcctgtaggcatttgcctgaaatatttccgcttcttcccgtttttgaggaagtgacttgtcgggacgtgtgaatcgtatccatattttcacggaatgtcctccggaacccataaaggctgcgaatgtatgtgaaagttcggccgcttcctgcttcacccggtttacttccatccggttggcgagatgattcacttctatttgtataatgccgttatatccggtcatctgtataccgttgactgttttgcgaaaagtggcagccgggacaactttgaccaatttcttgacgtcgtccagtttgctgtccggtgatgcgtaacggatgctcgtgcgtaggttgctgactggctgggctttcgtttcatgcttcatcgtttctatttgtatgtttatgtccaacgttcgcatggttgtcgtttctccgttgtcccgcatcaaagtaagtttcatgatagatgtgtttttgtttatgtctctttatttaaaaggcgagtaaaggtatgttttattattggactctccaaatatatcatcttctctttgttggaccttcttatgtactgtctcttacattggctattaatagaaaagttcctttcttccctatgcaaagtttcttttggctgtttgcaatctataaatgaaagctttgattatataaatgcaagttccgtttttataaatgaaactttcatttataaaaacggaacttgcatttatagtttgaatcaggtgaggaataagttttctattaatgaaaaggaagtttatatttaatgaaaaggaacttatctattaatagttcaggaaagaaatagctgttcctttgaatgtgataagtggtgaaagatgaaagattgggtgatagattgaaaaagaactgtcaatggtttgaaagtacgatgaacaaaaggatttgtgactttcggtgaaagatgaaagatataaataatatatttataatgaatgctatctttttgttgttgtgatttgcaaaataaaaaatgtcatgatagacatgtttttcgcatcaatagttctgtttttggtctgtttagacatgattggggcttttgtaattttttcctgctatattattcgttatatttgagacttgtaatgatgatgcggtgaactagaatatggagaatatgtttgtccaggtctctgaaatcgccaatgaaaggactgcacaaggacaacattttagcagtatgatatttgtatctgttaaaagctaatactgattatcgtgctgctttcttattttatcagataaatgaagaatttattcgcataattctttttatgtttccggtttattgtatatcaggattttaacctgtggtgcttacgaggagtttgttgcgtataccagtgatatgaaaagactgaacttgatatgttttgtaatgaaggtcataaaaacaatagatattaatattgataaccatgattaaagcaacagattttattcatcctgaggatgcagctgcattgaggcagttggaaagtattcccggattcccgaccctagtgaaaaagttaatgtcaatgggattggaacaactgcaatatggcgttaatatggcatctgcaattcgtttatcaccgagtcaattgccgaaactgtataatcgtctgccaccgatttgtaaaaagttgggtattgagcaaccggagttttatctctctatggatcctaatcctaacgcatggacctttggcgatacaaagatttttataacgatcacttccggtttggttgatatgatgaccgaagaggagttggatgcagtgattgcccatgaatgcgggcatatcctttgtcatcatgtcttgtatcattctatagctcattatgtgatggatggtctggattcgctgggcgttttggggagtttgggagctcctcttcaatatgcgattttgtattgggaacgtaaaagtgagttgtcctgtgacagagctgccagtattgtgactactccggccatagtggcaagcacgatggctcgtctatccggaggtccgacttctataacaaagaatatcgatatggaggagtgggctaaacaggcagaccaatatgaggctatccgtaatgacggattatggaataagacattgcaggtagcggcaataatgaatcagaatcatccgttctcggctgtgcgggttaaggaaatcttgaaatggggaaaaagttctcaatataagactatagtagatcatctttcggcagaaaaatcaggcaaggtatgctcgaattgcaaacaaccgatagtggatggctggacctattgcaaacattgtggaaataaactttaaatataatagcttatgttttttaatgaacaaggaatgttgaatttagacgaggcggtcatgaaccagcccacattcaagaagattatggaagatggtatagttactgaacaggagatcaaggaacagtctgaaagaattgtttctatattgaagtctatggaaaagaactatacggaagagcaacagcgtgaaattaaagaattgcttgttgaagccggtgtgttatttacaacgagccaatatcatgcattacagtcattacacttttaaaaaatagaattatgggaacatttgcaacaaaaaagatacttcagggcaatccttctttgattcctgttattgctgaacaaataaaaacagaatttgcggccgagcagtttgaggtacaaatagataatttattaagtggtggtgttgatatttctatatcaaagggcggtttatttaaagctgtacttggtttgaagtctgcattgaaagtcagcttgatacctaaagataatgcaatagcgtttgaggctgggatagggatctttggtcaacaagctattcctactatcatttctatgctattcttctggccggtacttatcacgcaaatttgggggatagtacaacagtccaaacttgatgataaggcgctcgaaatagctgaagaggtgctaaaaaatcgggattcttttacaactctgaatttggatattaacggtatggtattctgtacgaactgcggatatcggaatatcaaaggtgcaaaattttgttcggaatgtggacaggcattgtaaggagttaaaagcgatggttttattaaaccatcgcttttaatgaataaaatagtaaaggtaagtagcaaggactataagaataataaaggtaagattctagataattctatagttataatgaaaatgacatgagtaaattacgtttgataacagtattcctttttgccgtcttcatggtattgggagttacagcacaggttcatacccagaaggggatagtccgcaaggttacccgttcggcttccgatcctttcattccggtgcagggtgtacaagttattgtgtcgggggaagctaataaagcaagtgataaggacggacgattttcgttgaaggtgaaggtcacggataaggcgggtagttatacactgacagccgtgcgtgtgccacaaggttccaagtatatgttggcttcgccatcgaaaggtaaacgactatttatatctgccaatgacttggaagtctcgttgataacaccagaagaaaaggagatggagtataagaagcggtatgagttactgaaagaaaagtatgaagagcagtcgttatctttacgtaaactacgcaatgaactgaataagcgtcttggagaattgagcgaatcggatgtacattatgcacgtctgaaagcggagtgtgacagcatccgcaaactttatcttgattacatcaacaatgaggataagatagatgaggttatcaaggaattagctgaagagctggcactgaccgattatcagagcttggactctttggaactgaaaatttatgaactgaaaaaaaacggagaatggaaggcacttaacgacttgatacgcgagtctatgcctggtggagccgaggaagcctggaaagtgattgaacaacagcaacggaatgcggatgcaaaagtagaacaagccaagcttgaattagctagaggactgtcagaacaacaacggttgatacaacaacgcagtcaatggtttgggaaaatggagactgctatcgaatcattcaagatgcagcatttgaatgattcggtttcgcattattatgagattctcacgaaagctgctccaacaaattgggattatttgattgcagcgggaaggtttgaagaagattatatggctgattacaatcgggctatgaattatcagttgtctgcattgaatacaacagacaatgatacatacaaagcaactagttacattataatagggggaatatatgagaagctagatgactattctaaagctttggaatgttatgaaaagtctttgaagattcggctatctgtttatggcgaaaatgatgaaattgtggctaatgattatgaacgtatgggacagatatatttcgctcaagatgactgttctaaagctttggaatattatgaaaagtctttgaatatctatttgatgatttacggtgagaacgcttcatggggaatagccaatgtatctattggtatgggacgtgtatattcaaatcaaggagattactccaaagccttggtctgttttgaaggggccttgaaaatatttttgttgcttaatggagataaccaccctgctgtagctacaagttacagttatataggacagatatattttgctcaaaatgactattctaaagctttggattattttaaaaagtctttgaaattggatttgtcgttttttggtgagaaccatccttctgtagcttccggatattataatattgggtatgtgtattttgctcaaggggattactctaaggctttggaatattttgaggaggttttaaagattcgtttgtcagtttatggtgaaaatcattcccgagtagcttctgtttacaatgatataggagaaatatattccgttcaaggagatgatttcaaagctttggattattttaaaaagtctttgaaaatagttttgtcagtttatggtgaaaatcattctcaagtatcttctatttatgatcatataggagaaatatattttgctcaaaaagattattctaaagccttatattattttgaagagtctttgaaaatccgtttgtctctttttggtgagaaccatcctgaggtagctttgagttattatagtatagggagtttgtatataattcaaggtgacaaatccaaagctctgaactattatgagaagtccttgaaaatccgtttgtctgtttatggtgaaaatcatcctttgacaaaggaaattatggatttgattaatgttgctaatagtaaggtattacaatctcctgaaacaacaaaataatttatgaaaactcatattatattaggaaccatcaccgaaaagatctttcgcttttgagcgaggaatgtcagaaaactatattgttcttgagtgtgctgatggaggatagaaacaaatatattaatgtttttgatttgaacaataatatgataggcatgcaattgcagatatatcccatgaatgtgtaggaaaaagaaaaaatagtggaatgttatcaaatgtggttaattttaaatagaaatcagacgaaatggcacacaatttttttgcttttattagctatcgtcatacggacattaaggcggcgaagcgattacagtttttattagaatcgtacaatttgccgacaatgattcagaaaatgaagccggaggcacctaaacggtttaaagtctttcgtgatgctgatgaactgacgagtggtgtacttagtgacgaactgcatcataaattggatgaatcgaaatatctgattgtcatttgttcgccgaattcggcacaatcgaaatatgtaggggaggagattgcctacttccgctcgaagggacgcgaaagagagattataccttttatcattgacggtattcctcattccaaagatcgggaatgttttcatgctcaactgacgttaggcggattggaacttttggggattgatgtgcaggcggaaaattcaagattccatgcgatacgtttccatcaagcatttatccgtcttgtggcaagaatgcttgatgtggactttggcgtattatggaaccgtcgaaagcattttctcgttaagctggtcgctttgatgattgttgttctttccattatcatcggactggcagtgaacgcaattcattcacgtcctttcgatttagcagtgcaattatcacaaacaccttgcaaggctctcccacttagtgccgatgaaacagacagtctgtatctgtttctaggtgaaaatgatctacgcacagtggttctaaaagatttggataatgctgttttgtttcccaacattccgggaaagtataaaggacagaatatgagaattgttgcaaaggcttatggttgctatgtgttggacacaatcgtatctattacttcaaagatggcattgcctattcaacggaatcctgaaacgtttgggcatattcaatactgtattgtagataatgaaacggaaaagcaacttataggtgtaacattcgactttggctttctgaaagtgaaaacgaacgatgaaggtatactcgatgtactcattccaatagaccggcagcaggtgtcttatccggtgaaaattgattataacggaatctctatgcatctgacctattctggagattcattgcaggcgtccggtcatactggtcttagtacaatttatgttcaatattgagatatgaaaaatagtggtatagaaacgtttactcatactaaactcactaaagccgaattattcataaattttatccaaaagaagagaaaagaataaaataaacaagagacgtcgtaacaacctatccataaaacgattatatttattgcagcgagagagcactttaagtaatgcttaagaggaaaaacgaaaagtagtatatatactatatattttctattattaattacttaaacacattttttatggaagccaagaaatcaaaaaaggctgcaattgagaatcaacggggttcttggttgttgatgggtttggttgttgcgctagccttcatgttcgtttcgttcgaatggacacaacatgatgtcagagttgcagcactatcaccagatgatgaatccatctttgtaacagagctagttccaatcacattccctgaagagaaactggaaccgcctcctcctcccgaaactaaggtaacagaattgttcgaaatagtggaaaacaatatggaggtgacggataacgtttctacagtgtcagaggatatgaatgcagttcatgatgttatttggatacccccagtggtagaaacagaaacggtagttgaagacgttattcacgtaagtgttgaagtcatgccggagtttattggaggtacagctgctttaatgaaatatttaagtagtaatatcaaatatccaacgatttcgcaggaaactggttcacaaggaaaagtcattgttcagtttgttgtagacaaagacggaacgatttccaatcctgaagttgtgcgaggggttgatccttatttggataaagaagctatccgcgtgataagttctatgccgaaatggactcccggagtgcaaaatggtaagaaagtacgagtgaaatttactgtaccggtatcattcagactacagtagtaacttggaataaatgagtatgagggtcggttctttatgggaaccgaccctttttcaataaaaaaatatatctttgtcgggagaataaaaatacgaatgattgttttatgaatcttctactctgtataaaaagaccttttatctggctttcccgctttcgttatcgttgcggatatggcgtacattccccttttgcttttagtctgattaccgatgtgatttatgagaagatgccttactatgcctattcttctttgaaaaaagaacagaaaaagatgataagagagcgtgggtggactaaaggttctcaaaaggtaaaccgtttcctgttccggttggtgaacagagtacagcctgatacgattatagaagttgggcgtccttcctccacaaccctctacttacagtctgctaaaccatcggcttcctacctttttgcttccgacttgtcggaactgtttctggatgcagacacttcagtcgactttttgtatctgaatgactaccggaatcccgacttactggaagaagtcttccgggtttgtgcacatcgtgccactcctaaaagtgtatttgtggtccatggcatctgctattccaaagagatgaaagcactttggaaaaagctgcaggctgatgaaagagtaggcatcacctttgacctctacgacgtcggtttactattttttgataaaacgaagataaaacagcagtatattgtcaacttctaagaacctttgtacgtttaccttataataagtaaaaaagaagattatgaaaaagagccttgtatatacaaagaccggagataaaggaactaccagtcttgtcggcggaagtcgcgttccaaagacccatatccgtctggaagcttacggaactgtggatgaactaaattctcatctaggatggttgaatacctatctgcaggatgaatcagaccgtgatttcattttgagtattcagcataagctatttgccatcggttcacatctggccaccgaccaggaaaaaacgcaactgaaggctgccagcatcataactcctgaaaacgtggagaatattgagcgggagattgataggctggacgaacaactgcccgaactttgcgctttcatcattcccggcgggagtcgtggagcagccgtttgtcatgtttgccgtactatttgcaggagagccgagagacgtattctggctttatccgaaacttgtacaatttctcccgaagtattagcatttgtcaacagattatcagattatttgtttgtattatcccgaaaaattaattttgatgagcaaaataatgaaatattttgggataatagttggaaatgatagattttattatacttttgccgaaaaatagaaaacgagacaaatttagtattcattttaaatactcaagattatgtattggacattggaacttgcatcaaaacttgaagatgctccctggccggcaaccaaggacgaattgattgattatgccatgcgttcgggtgctcctcttgaagttattgagaatctccaggagatggaagatgagggcgaaatctatgagagtatcgaagatatttggccggattatcctagtaaggaggatttcttctttaacgaggaagagtattgatttaaaaagaccgaacatataagaatacccgataactgttgtaagaagctatcgggtattttttattgtcagctcggtttcttgctttagaattagaatacaggcatctgccagataaatcctacagaaatacggttagtactgtaattctcctgtcccagcaccttggcgcgggaagtgaaatcatacgaacgtcctacataggtaacaaagaagtgcagattggtttccatcgggtaatattcgataccgcccagatatccccaggaagtacggtaatttcccttctctattccctcggacgccttgcctacggaagccgtctcgtacatacccttcacaaaaacattccatttcggaagaaagcggtaattacatttggcaacaaccgaaagatagttcgcatcaaaagcattatgaccgcccggacgacctacgatactggtaatgattcccttgcggtcaatatcctcttttgaatacatgaaatcgacaaaagcattccattttccaagatttaactcgttacctaaagcataataatacatattgtgacttttggcctcgttcataacagaagccgaccaacgggttttaaatacattattgaaattaccgttccagttcaatgtataaaccagtggcattttgcccgatttcagatcggggagattgccttcggcatcctctgtgattccgtaagtattatcgaaagaactgttgcggctgttcaatatctgcaagttaagctgctgttcgggagtaatgttataacccacattcaatccggtcatgaaattactcatgtaatcaatcatatcactgtattgatagatgtcaatcggattcaggtcgaactcgataccaccgtatgcggcacattgctttcctgcaaaaagactaaactggtcattcagcttgataccgattccggcatagtcgatagaagtcgggagattatcaatcatgccgtttgcatcgttcgagcggttgaggcgctgacgatagcggtaagacagccagttgttgatatttcctttggcttcgatacgaagctggtgcatattaaagtcaccctcctgaaaaccattctggaaatgagcgtcaaagctcccttgcatattcagataaagattgaatttatctgttttctttttcacgtctgtcagctcttcaaacaggggagtgttcggattgaatttctcctttttctctgttttttgagcatatattccctgtatgctacccgcgaggagcagcatgaatatccattttttcataagtaagtcaggtttttagtattcgttgaaatattgctgaatctgtttccagtctgtagtttttgttagtgcaagcattaacaaaacacgagatttctgcgggttcagttcctgcgaagccacaaactgatatttggcgtcgtccacctctgcatccagtgtggtaggtccggtcgggacacgggaagaacgaacgacaagaatacctttttggcgggcatccgtcagtaccgggaagatgttctggtgaatatttccgtttcctactcctgcgtggatgatgcctttgtacccgttgctaagcatcggagttaccatatcggcctcaatgttggaatagctgtacacgatacctactttaggaagcgcgttcagatgagtgacatcaaaaacggactgggtagtatgtttttttagcgttacttggttgtagaacacttttccgttcagtacataacccagtgcgccggagttgggagcctggaaagtttgtacgtcgaccgtattcattttaaccgtgctctgcgctccgaggatcaggccgttcatggcaaccaatacccctttgtctttcgattcttttgcggctgcggtaacaacggcattgtaaaggttcaacgggccgtcggcacttagagcggtagacggacgcatggcgcctactaataccaccggtttgtcactcttgacagtcagattcaggaagtaagcagtttcctccatggtgtctgttccgtgagtaatcacgatgccgtcaatgtccgggcgtttcagtagttcattgattttcttggcaagcgtcaaccaaacctggtcgttcatgtcctgcgaaccgattttgacaatctgttctccggttacgttggcgatgtctttaatttcaggcacagcgtcgagcagtgcaccgatggcaacttgtcctgccgtataactggttccggtagccgagcttcccgtacccgcgatggttcctcccgtagcaagaatatgaatattcggttttgcggcgaatgccatagttacggaaaacagtagtgtgactactaccagtccaaagcttttgaattgtttcataactgaatgatgtttaggttaataatatgaatctattagaatatttgtataaaaagcaaacctagtgcaatagccacaacggtcgataccagaccgggcatcatgaacgaatgattcaacacatatttgccgatttttgttgtcccggtacggtcgaaattaattgcagccaccacggtaggataattcggaataaagaaatatccgttcacggccgggaataaagcgatcagcatataaggagaaatccccaacgcaatgcccagagggacgagtgcccgtacagtggcagcctggctatatagcaggatagacatcacaaacagggcgacaccgaacaaccacggcatttgttgcacaattccctggatagagagagtcaactgtcccatatttccctgaagaaaggtatctcccatccaggcaataccgaagatggcaatcaccgcctgcatacctgccggaaatacagaaccttgcgttgccttgatcccgtccgtcttcgttactaacaggataattgcggcagccgacaacatcacgatttcgatgatagaagacattcccaaggtgacaatttccccatcaatcaggaaactggggcgcattccttcaaaagaaccgaaaagcacgataaaagcagttgccaatataaagatgataacggaaatcattgccgaacgtttgttcttgacatttttaatctccacctttttattgttgaataaaccttctttcaatctcttctgatattcgggatcttccaccagttccttaccgattctcatggaaaacaaggcgcctaccaacactccgatgatggtggcgggaatcgtaattttgagaatgtcgaacagggtaatgtcgaatccggctaaaagtccgagaagtgccacggtagcggcagagatcggacttgctgtaatggcctgctgggaagcgatgacggcaatacccaacggacgttccggacggatttttgtttcggtggcaacctctgcaatcaccggcagtacggaataagccacgtgtccggttccggctacaaaagtaaagaggtaagtcaccagcggactaagcagagtgacgtgtgaaggatttttacgaagcaaatgttctgccagtttcaccatatagtccaaacctccggctgcctgcatacaggaagcggcagagattacggcggcaatcattaacataacgtcgatgggaggcgcagtgggttgtaaaccaaaaacgaacgtgagtattgccaaccctacgcctcccattacgccaagtccgatacctcccaggcgtgcgccaataataatggctgtcagaacaaatgctaattgtaatatcatagattgctgttttaagttcaaaaacaaagataagtgattcttctctttgtattttctttttcttctatttacaacaaaaaagtctttgaatagtttttgcatatttattaaaacaataacatcgctggttggttattataagaactaacgaaaacgttattactataaaacaaccgatatggaacaaaatttatcaaaaaaaactcgtacagagagtgacctgataggtagtcgtgaagtgccggaaagtgcactctatggagtacagacactccgtggcattgaaaactttcgcatcagcaagtttcatttgaatgaatatcctttattcattcaggcattggccattacgaagatgggagccaccattgccaaccgtgaactggacttattaactgaagaacaagcggatgctatcttgagagcctgtaaagaaatactcgaaggaaagcatcacgagcagttccccgtagatatgattcagggaggagccggtacgaccactaacatgaatgccaatgaagtgattgccaaccgggcattggaactgatggggcatcagcggggagaatatcaattctgttcgcctaacgatcacgtcaaccgttcacaatctaccaacgatgcttatcctacagccattcacattggactgtattatactcatttgaaattggttaagcatttggaggttctgatcgagtctttccggaagaaagcgaatgagtttgcacatgtcatcaaaatggggcgtacccaattggaagatgccgtaccgatgactcttgggcaaacctttaatggctttgcaagtattttgtcacatgaaataaagaaccttgattttgctgcacaggattttctggcagtcaatatgggagcaacagccatcggaacaggaatcaccgccgaaccggaatatgcggagaagtgcattgccgctttgcgcaagattacgggattggatatcaaactggcagacgatttggtgggagctacttcggacacttcctgcatggtaggttattcgggagtgatgaggcgtattgctgttaaaatgaataagatatgtaacgacttgcggttgctggcttccggtccgcgttgtggattgggagaaatcaatctgccggcaatgcagccgggctcatccatcatgcccggaaaagtgaatccggtgattcctgaagtgatgaaccaggtggcctacaaggtaataggaaatgacctttgtgtggccatgagcggtgaagcagctcaaatggaactgaatgcaatggagccggtgatggcacaatgctgtttcgagtccgccgatttactgatgaatggttttgacactttgcgcaccttatgcatcgacggcattacggctaatgaagaaaaatgccggagagatgtgcataacagcattggagtagtgacagccctgaatccggtgatcggatataagaactctaccaaaatagccaaagaagcattggaaaccgggaagggagtttatgaacttgttttggaacataacattctttccaaagaagacttggatactatcttaaaacctgaaaatatgataaaaccggtgaagttggacattcacccgaatcgttgattgatatatagtaagtggagattggtttaagatgagaaatcgccgggcagatcattgatctgttccggcgatttttgatgatgtactgcttttattcgatatggaaataattgctaatcttttaggatattatattgtctcgtccggatttaggttgactgttttgacttcttaatcctattaataagtaacctgatttttggttaacggcagtttcaatttgtttcatacgcttgaaactctttgtttataggtttgaaacactttgtttcaaagcttgaaactattggtttcacaccgagaaacttttagtttcactatatgaaactaaaattcgtactattggactggaactttcgtatggagaaacctgttgcatggtgagggtaaaaagttaccctcaccatgcccttacctttactcccacacctgtaatgccgatgaataaagggattgaaccaatgggtgagagtgtgagagtaaaaactgctataacttttatttgtgagagatatttcagtaatcaagaatgagaagtagagtcgtcttttgtcagattcattttaatacataacttccagtatttatttccatatttcgactgcgtttcaaaaaaaacatatatctttgccgtacgctttcagcccatcagcgtgatggaacaggcaggaagcggtttttatttcctatatggagtaaaagcgtattatctctcgatttcagaaatagctaattcaaacagagggagatgatacggtagatactccacgtgaacggtgtatatcaacatattcgtaagagatgtgttatatataaacgattgacgtgggtgtctgctgtcatcattgttctctggagggtgtagctagccttgaaatcggataatggtacagcagcatctacgtctttcttgtattcggccagtaataaattgccccaattttaacctagccaatcggcggactgcaaaaagcgtggatgcccgttgtactaatatacatgaataaaatattattcatcccttatttgtatcacacatgaaaaaacaaacgctatggcacaatggattagtatagaagaggcagctgcaaagtacggattcgagacagaatatatctgggtcttgatagagatgcgagaaatcactgtggactacgaaagaccgggcatcgacatcatcagtgatgacagtgttcaggagtttatgagtcgaaatgaaagaggggctactttgatgtatatcgaaaaactggaacgatattgcatagataaatcaaaactttgttcaatatacctatcacttttaggcaaacaagacaaagaaatcacaagatataaagcagccggaatcctttatgataccttacaaatcaaatggttgaaacaatgtgaccgattgcggaagttggaaaaagaactcgtcttggggcagactacttgctgtacctgttggctgaaaagaatctgtatgaaaatcaggaagtaaaatcggattatcttttttctactcgtagtatgttactgaataaccgggaccgggaacatcaacaaccggtgaaactactgtatggatcgttgcaattatacaaaaaattgcaggtactattattttttttgtaacttcataaaatatttcttcatctcgattgtctataagagtagagggctcttttaactaataagaatgatgaattaaaaaaatgaagtataatggcaacaaaaagttttaatagaagatttcatggaagatgtggcggtaagttttcttttttcagaaatccatttgtgtttgtaattctttggctagttgtagctgcgggaataggagcaatagtcatgttattgtggaattggctgatgcccgtgatttttggtctgcctgcacttagtctgtggcaggcattgggcttgctcgtcctgatgcgtattcttttcggaagtttcggttttggccgtagaggagggaggcccggaggagggatgcctggaatgcccggaagaggaatgaatccggttcgtgagaaatggatgaagatgactccggaacaacgcaaggagtttattaataaaaggaagaaaatgggattcggtccctggggtagagacgacttctttaacaggggtgacttcgggatggataaagacttcgagatggatgaaaatgtagactcttcgaaaaaagatgaataagcaaaaagggcacgaaggcgatgtggagcggctgatcgaagaacatcagccgcaactgaaagcctttatccaccggagggtttccagtaaggaagatgcggaagatattctacaggatgtattttatcagttggtaaaagcggtcagcaacactttgaatccgattgagcaggtgacgtcgtggctttacagagtgacacgaaacacgattatcaataagggaaaaaagaaaagtgaagaagaatggcctgtttctgcctacgcagaggaagaaagcgtcttgagtgaattttcggaagtgttgtttgccaatgatgatctggctccttcgcctgaaacggaatatatgcgttcgctggtatggcaggagttggaagcagctcttggtgaattgcctgccgaacagcggacggttttcgaactgatggagctggaaggactttctgtaaaagaggtagccgaagcgaccggtgcttctgcaaatacggtgctttcgcgcaaacattatgccgtcaagcatttgcgcaaacgattggaaggactgtataacgatattcttacttactgatgatttctattaactaattactttctctttcctatctgccgtccggcggatagtttggaaaactcctgtctatgcaaatagttatatcaatctcccttgcgggatattggtaagggggattctatgccctaccgggtacttactaatcacttacataaacgaaaagaaaaaatgaaaacaaattatattttactgtttgcgctgatgttgatggtgtcttaaaaatcttctgcacagatatttagcggtcgggttattggtgaaaatcagcttcctgtggagtatgccacggttgcactattgtccgtgccggattctgcgcttgtgggcggagctgtgacggatagcaaaggtgtgtttaaaataacggcacaggatgccgggccttatttgttgtccgtgtcttttgtgggctataagaagttcgttcagagggttgcgtcttctgtggaggaaaatatcacgctgattcctgatgatttgatgttggatgaggtggtgattacgcagcgtcttccccagttccggttggataatggaggattgactacgaaagtggagaatacaatattaagtaaggcaggtactgccatgaacgtagtcgggcttttgccgggagtgttgaagaagcaggatggcacgttggaagtgttgggaaaaggcgttccgcttatctatatcaataacaggaaagtccgcaacttggacgaactcgaccgtttgaactctgaaaatatcaagcaggttgaactgataaccaatcccggagcggaatatggagcatcggtaggagctgtcctgaaattgaaaacaaccgggaataaaaacgatggctttggagtgggagtgcgctcggtagtggattatgcgcataaggtaggaaacaacgatcagatcaatatggaatatcaccggaagggactggatgtgttcggagctttccaatatcgtttggagcatctcaaggaaacgggagaatcggtacaagatacgtatgtggatgcttcgtggcagcagaaagctcaaacaacggatttaggaagaaatatcagttatttcagtcagataggatttaattatgaaataaatgaaaaacactctctgggcgctacttatgaattgacttctgccccacgcaataaaatgaacaatgacaaccggacggaggtctatggcgggcaagcattatacgatgtgtggaatacgtatacctttgcgattgagaaagaatatcccagccatcattccaatgtatattatcatggagaggtgaacagtctggaaatggatttgaatgtagatgtattggctggcaagaataaggaagaggagcatattagcgaattgagccgcaattatgatgatttctacataacgactcttagcagaaccgataataagttgtatgccggaaagttagttttatcttatccgctggcaggtggaagaatttccggaggcagtgaatatagttatacgcatcgcaccagcgacttttcggggttcggtgatgaaatagagggaaccagtgataaaatcagagagaagaatctggctttttttcttgattgtgtttatcgtttgggtggtgtaaatgcttcggcaggacttcgttatgaagatgtgtattatgatttctatgaaaacagtctttatcagtcggatgagagcaaacactatcgcaacctgtttccatccttgtcactggaaggggcgatggggcaggtgcagtgggcattggggtatcatattcaggttgcccgccctcattatgaacagttgaaaaatgccattcattacgggaaccggtttacctatctgggaggagctcctaatttgcaacctacctatattcatgcggcagagatgcgggctatctatcgggatctgcaactctccgtcggctacaatcggtataatgatgatatcctgttttctatcgaacagatcacttccgatccgaaaatctctcttattaagtttcgcaatgtcgaccatcgggatgaaatgactgcttctctggtctttgctccaagtatcggatgctggaaaccggagtggacggcttccctcaactctcaatggttcaaaatcggttatttgaatgaaatgaagaatatgagcggaacgacattcgggatccggtggaataattcatttcaattgcctgccggatatatatttcgcttgaatggtgaatatacaggcaagggagtgtatcagaactgttatacaaggcccgttagttgcttgagcacaagtatctataaatcgtttttcaacggacgtgtggactgcttgctggaggggaacgacttgtttcattcgatgagggatgctaatactcaatatgacgaccgggttaaaatgttccgggagacaaagcggaatacgcaggaagtgaaactgactgttcactataagtttaatttgcagaaaagtaaatataaaggtacgggagcaggattgggtgaacaacaacgactttgagcgaacaaaaaaccaataatttgtgtttatttaatctaaatatatatctttgtcccgaattataaacacgtaaatttatgaaaaagatttttggtgctttaatgattgctatatgtatagctatggcaatgcctgctcaggcgcagatacactttggtgtaaagggaggtttgaacttgtcaaaggcgagtttctctaatgtgagcgaaaactttaaaaaggataatttcacaggtttctttatcggtccgatggccgagtttaatattccaatcgtagggttgggagtagatgcatctttgctttttgctcaacggggtatcaaagtttcagaagggaatgatgatattactgttaaacaaaacggtattgatattcctgtaaacctgaaatataccattggcttgggaagtctggctggtatttatctggctgcaggtcctgacttttatttcgattttgaaaagaaatcgggaattgataagaagaaagctgaagtaggtatcaatgtgggtgccggtttgaagttgctgaaccatttgcaggtgggtgctaattacaatatcccattgggtaatactgctgatattgaaggaacaaatgcttcttataagactaagacttggcaagtatctgtggcctatattttttaagtagtctatcactttacatagtatatgaaaaagagtttccgataaccggaaactcttttttgtttgggattgtcctgttgcgctcttgaatatatttcttccaattctcgtatgaagtagagttttctttttaagtgttctctctcccttcttttaaatccccatttttttattgtatttttgtagctgcaatgaaaaagtatgtagatgtcatattaccgcttccgcttccgaagagttttacttactctttgccggatgaatgtgcggaagatgtgaagataggctgccgtgtggtagttcctttcgggcggaagaagttttatacggctatcgtccttaacgttcattattgtgctccaacggagtacgaagtgaaagatatatctgcattgctggatgcttctcccattctgttacccgctcaattcaaattttgggagtggatagctgattattatctctgtacacaaggcgatgtctataaagcggcacttccctccggcctgaaactggagagtgaaacgatcgttgaatataatcctgattttgaagcggatgcgccattgccggaacgtgagcaacgtattttggatttacttgccgtagattcgcaacagtgcgtcactaaactggagaaggacagtggtatcaaaaatattcttacggtcatcaagtctttgctcgataaagaagcgattttcgtaaaggaggagttgaggcgtacttataaacctaaaacagaggcacgggttcggcttgcgggtacagcggatgaaaagcggcttcatatcctgtttgatattctgtctcgtgctccgaagcagttggcattactcatgaagtatgtggagtgttccggtgttttaggagcgggaactccgaaagaagtctccaagaaagaactgttgcagcggactaatgtggccccttctgtattgaatggattggtagataagaagatttttgaaatctactaccatgaaatcggccggttggataagcaggagaaggagattgtcgaattaaatcctttgaatgagtttcaacagcgtgcatttgatgaagtcgtacagtcttttcaagagaaaaatgtctgtctgcttcatggggtaacgtccagtggtaagactgaaatttatatccatctgatagaagaagcgattcgtcagggaaagcaggtgttatatttgttgccggaaattgcattgaccactcaaatcacggagcgtttgcaacgggtcttcggtgctcgtctgggtatctatcattctaagttccccgatgctgaacgggttgaaatatggcggaagcaactgggagagaacgggtatgatattattctgggtgttcgttcttctattttcctgcctttccgaaatctgggattggtgattgtggacgaagagcacgaaaatacgtataagcaacaagatcccgctccccgctatcatgcgcgtagcgcggctattgtactggccgccatgtacggagctaaaaccctgttgggtacggccactccctctatcgagtcatggcagaatgcaagagagggaaaatatggtttcgtacaactgaaagaacgatataaagaaatccagttgccggagattattccggtggatatcaaggaactgcatcgcaaaaagcggatggtcggacaattctcgccacttctgatacaatatatgaaagaggctttggaacagaaagaacaagtgattctctttcagaaccgtcgtgggtttgctccgatggtggagtgtcgtacctgcggctgggtgcctaagtgtaagaattgcgacgtaagccttacctatcataaaggaatcaatcaattaacctgtcactactgcggttatacgtatcaactgccgaaatcctgtcctgcctgcgagggaacagaactggtgaaccgtggtttcggtacggaaaagattgaagacgacatcaaaatccttttcccggaagctgccgttgcccggatggatttggatactacacgtacccgttccgcctatgagaagattattgcagactttgagcagggaaagacggacatattgatcggtacccaaatggtatcaaaagggttggatttcgatcatgtcagtatagtaggtatattgaatgccgataccatgttgaattatcccgatttccgttcctatgagcgtgcttttcagttgatggcacaagtagcaggacgtgccgggcgtaagaataaacgcggacgggtggtattgcaaaccaagagcatcgatcatcctatcattcatcaggtcattgccaatgattatgaagatatggtaggcggacaattggtggaacgtcagatgttccattatcctccctattaccggctggtatatgtttatctgaaaaatcataatgaagcgttgctggatcagatggcggcagtgatggcggataagttgcgggctgtatttggcaatcgggtattaggtccggataaacctcctgttgcccgtatccagactttgtttatcaagaagatcgttgtcaagattgagcagaatgccccaatgggacgtgcacgggaattgttgctacgtattcagcgcgagatgttggcggacgaacgctataaatctttgattgtctattatgatgtagatcctatgtgatttaataattttcccccatataataacctttaatcatttaattaactaaccatgaaacgacttactattttttctctgacttgtctctttagcgtgggtgcagttttagcccagcagggagtaactcaatgtggtgttccgacaggacaaccgaagttccctttactgacttatcaggagttgcctgatcctactgcaccttctgataaagagtgggtagcggtgacttccacccaagtttcttggggtacaacagatgtacggtatgcaaaacatcaactcccgcagttgaagaaacaacagactgtttccctgaaaggctggcgtggcgaacgtgtgaacgcgcaagctgttgtgtggacaggcgtagaactgaaagacctgaatttcagctttggtgattttaaagacaaaaagggaaatgttcttcccaaagatgcatttacaggtggttttgtccgttatgtgatgacggatgaattgaataaggatgggagaggtgcctgtggacatcggaagtctatagattatgattcattattggtggccgatcctattgataccaacctgaaaacgatggctttgcccgctcgtactgttcaaccggtttgggtgcagtgttggattcctcaatcggctactcccggaacttatcaaggggagttattaattaatgatggctcgcgtttattgcaacgcctgaatctcgaaattaccgtttcttcccgtgaacttcctcaaccttcggaatgggcttatcacttggatttatggcaaagtccttatgcagtggcacgttattatcaggttcctttatggagtcaggagcattttgacgccatgcgtcctttaatgaaaatgttggcagatgccggacagaagattattacggctactttgacgcacaagccttggaatggtcagacagaagattattttgatacaatggtcacttggataaaacgggcagatggaacatgggcttttgattatactatcttcgaccgttgggtggaatttatgatgagtgtaggcattgataaacagattaattgttactcaatggttccatgggaattgtcattccaatactacgatcaggcaaccaactctctgcaattcgtgaaaactgcaccgggtgatgcggcttatgaagaaatgtggggagcgatgcttgcctctttctccaagcatctgaaagaaaaaggatggtttgatatttgtgctattgcaatggacgaacgtccgatggaagtgatgcagaagacgttgaaagtgattcgtaaagctgatccggattttaaagtatcgttggccgggaactatcatgaagagattgagcccgatctatatgattattgtattgttatcggacagaacttcccggaagaagtgcgtctgcgtcgtgtagccgagaacaagcgtactaattattatacctgctgtacggaagcccatcccaacacgtttactttctctgatcctgcagaagcagcctggatgagttattattcatctaagaaacatctggatggttatctgcgttgggcatataacagctggccattggagccgctgcttgattcccgtttccgcagttgggcaggcggagatacttaccttgtatatccgggtgctcgtagctgtattcgtttcgagcgtttgattgaaggcatacaggcgcatgagaagatcaatatccttcgtcaggaatttgagaaaaaaggaaataaggccggattaaagaaaatagaaaaaatgcttgctccgttcaatttgggtagtatgccggaaatcccggccgcaataaccgtgaaccgggccaatcagatactgaactcattttgagaaacaatcatgtatatatgaagaaaatattatttgtctgtttaggaaatatttgccgtagctctacggctgaaggcgtaatgcttcatttaatagaagaagcgggactggaaaaagaatttgtgatagattctgccggaatcctgtcttatcatcagggggaattgccggatagccggatgcgtgctcatgcagcccgtcgcggttatcaattggtgcatcgttctcgccccgtccgtacggaagatttttataattttgatctgataatcggtatggacgaccggaacatagatgacttgaaagacaaagctccttctcccgaagaatggaagaagattcatcgcatgacggagtattgcacccgtattcctgcagatcatgtccccgacccctattatggaggggccgaggggtttgaatatgtacttgatgttcttgaagatgcttgcgcaggtttgcttacttctttaactcaggataactgatccgggtgtgataagcaatctttagtttttctttgaacacagctttcactgttgctatatccttgaaagtgataggacattctttaaagtaaccttcagtgacctgggaatcgataatcttatcgaccaggttgctgattgtttcttctgtatattccggaagactgcgtgaggcagcttctacggcatccgccatcatcaggatagcctgttctttggtgaacggattcggcccgggataggtgaacagttcttcattcggttcttcgtccggatgctcgttcttccaggaaatatagaaatattttgtttttccccgtccatgatgcgtgctgataaagtccttgatggctttaggcagattgtgtttatcggctaacttcaatccatccgtcacatgactgatgacgacctgcgcactttgttcgtaattcaggttcttatgcgggttaactcctcctgactgattttctgtgaaaaaagcagggttttccatcttaccaatatcatgatacaaagctcctgtacgtactaactggcttttggctccaatgcggatggctgcttctgcagcaagattggccacttgcatggaatgttggaatgttcccggaaccgtctcggacatttgccgcaaaaggtcattattgatattcgaaagttctaccaacgttacattggaagtaaatccgaaagttttttccaataaaaagagtaaaggataggtgaataataacagaattccattgatgatgaagtaagtgtacattcgtatgttcaactttgaaaagtcggtggaaagaccgttctctgtcatcaactcgaaggcgaaataaatggctgcataagtcagtataaccaataaagccgttcggaaaagttgggacctttgcgatagctctcttagactgaatatcgccactaatcctgcagccaactgtgtcagaatgaattcatgcggaaagcgtaaggatatggagcatatcaatatagtgatgacatgcgtcaggaaagcagtcctcgaatcaagaaagacgcgaatgataatgggtagcatcgcgtacgggatgatatacacattaaatagattatgtgttaccatgaaagcggttatgacactgtaaaatacaatcaacgtgaatagcaatgacagactgcctttccgttgatagtagtcttttcggaacaggtcgagataaagcataaaacaaagcatcagcattcctacaaacagaatctgtccgccgagaatcaggcggttttgtcccatggactcattccgtttgatggattctttgcgtaatgactccaggatattataggtatgcgggctgacgatttccccccggtcgataatcttttgcccgctgactactaatccgtttgcccaggaatagttgttcaggatttcttctttggcagcctgggtacgttcctcgtcaaaggtaaggttgggggtgatgtattcgttcagggagcattgccttaaaatttcccggttgaaatgagtagagtctgctgacagcaagtgctcataggctttttttaccgtgtaaagattctcggtagcctgtggattagccagtttgtcatcaatcaccatgacagatgaagtgctgtctttgtgaagcagctgtatattctctgtcgaaacgatgcctgcctgatagatttcttttaaagtgcgctcaatgtaccgcaaataatcgatggaagggagaatacctttcagattcgtatggtaattctctttcagcttggcgattgcgtctttttctatatttttatccagttgataataaggttggaagaaagccatcaggctatcttgttccctttttaccactgcatcctctttataaataggaaagtcgaaagtagcgatcaactgtccgtatttccagggcttgttgatgtcgaactggtaattgaattttccgtcacgtggcaggaaataaacaatcagcgccacagtgcctacaaacagcagtgatttatatagtaaatctctccatgaaaatctttttttcttcttcaaatgttccatatccactgaaatttttgcgaaaagtacaaaaaaaaacaatagtgtggaaaaaaaggtttaattttgccacgatttacctatactaacccaaattatggcagaaagaaaagtaagagttcgttttgctccaagtcctacgggagcattgcacatcggtggtgtgcgtacagctttgtataattatctatttgcacgtcaacacggcggagacttgatatttcgtattgaagacactgactctaaccggttcgttccgggagcggaagagtatatactcgaatcttttaagtggttaggtatccactttgacgagggagtgagcttcggtggtgaacagggtccataccgtcagtcggagcgccgcgaaatctacaagaaatatgtgcagattttgctggaaaatggaaaagcttacatcgcttttgatactccggaggagctggacgctaagcgtgctgaaattgctaacttccaatatgatgcatctacccgtggtatgatgcgcaattcattaactatgccgaaagaagaagtggatgcactgattgctgaaggcaaacaatatgttgttcgtttcaaaatcgaaccgaatgaagatatacatgtaaatgacctgattcgtggcgaagtagtaatcaactcatctattctggatgacaaagtgctttataaatcggctgacgaactgcctacttaccatttggcaaatatcgtggatgaccatttgatggaagtttcccacgtgattcgtggtgaagaatggttgccttccgctcctttgcatgtgttgttgtaccgtgctttcggttgggaagatacgatgccggaatttgctcacctgcctttgttattgaaaccggaaggtaatggaaaattaagcaagcgtgacggtgaccgtctcggattccctgtatttccattggaatggcacgatccgaaatccggagaaatctcttctggttatcgcgaatccggttatttacccgaagctgtgattaatttcctggctttattgggatggaatccgggcaatgatcaggaagtgatgtcgatggacgaattgattaaattgtttgatcttcaccgttgcagcaagtcgggagctaagttcgactataaaaaaggaatatggttcaatcatcaatatatacagcagaaacctaacgaagaaattgcggaactgttcttgcctttcttgaaagaacaaggcgtagaggctcctttcgaaaaggtagtgactgtggttggcatgatgaaagaccgggtaagtttcattaaagaactgtgggatgtttgtagcttcttctttgtggctcctaccgaatatgatgaaaagacggtgaagaaacgctggaaagaagattctgcaaaatgtatgaccgaattggcagaagtgattgccggtattgaagattttagcattgaaggacaggaaaaagtcgttatggactggattgcagagaaaggttaccataccggtaatatcatgaatgctttccgtctgacattggtgggtgaaggaaaaggcccgcacatgttcgatatttcctgggtattgggcaaagaggagacgatagctcgtatgaaacgagcggtagaggttttgaagtaatcgatcagtactatgctttacgacctggcaatagtcatttatgactttatcgtccatttggctgctccgtttagccgcaagccccggaagatgatgaaggggcattgggtggtgtatgaactcttacgccaacaagtggaaaaaggggaacagtatatttggtttcacgctgcttcactgggggagtttgaacaaggacgccctctgatagaaatgattcgtgagaaatatcctaactataagatattgctgacatttttctctccttccggttatgaagtgcgcaagcattaccggggggcggatattgtctgctatctgccgtttgataagccgaggaatgtgaagaagttcctggatattgcaaatccttgcatggcgttctttatcaaatatgagttttggaagaattatctggatgagcttcacaagcgccgtattccggtatatagtgtgtcgtccatcttccgtcgcgaacaaatattctttaaatggtacggtggcacttatcgcaatgtcttgaaagatttcgatcatctgtttgttcagaatgaggcatccaaacgttatttgtcgaaaatcggcatcagtcgtgtgacagtggtgggggatacccgttttgaccgtgtactgcaaatccgcgaagaggctaaagagctcccgttggtggagaagtttaaaggaaacaattcttttacttttgttgccggaagttcatggggacctgatgaggatttattcctcgaatatttcaataatcatccggaaatgaaactgattattgctccgcatgtgatcgatgagaatcacctggttgagatcatcggtaaattgaaacgtccgtatgtgcgctatacccgtgctgacgaaagaaatgtattgaaagcggattgccttataatagactgtttcggtctgttatcctctatttaccgctatggtgaaatagcttatatcggcggtggtttcggggtcggaatccacaacaccttggaagcggctgtatatggtattccggtgattttcggaccgaagtatcagaaattcatggaggctgttcaattgctggaagcaaaaggtgcttattctatcaaagactatgatgaactgaaaactttgctggatcgtttcctgacagatgaggtgtttttgcgcgaaaccggaacgaatgccggttattatgtgactagcaatgccggtgcgacggagaagattatgcacatgattaatttctaaatatatattgtagatcaatgtgaattcgatataagagggcaatacaaaaccttaataaacaaagaatcacctttaccacagataattgtgataaaggtgattctttgtttattaaggagctttggcacacttctcattgctttcggctctttgtcaaattgggtggtaaatcctttagaaaaacaggcatctactgaattatataaatgaatagaggacaacttttcaccagatttgacgaagaacctgtttcctgcatttgtagctaggtaccttatctgttgacttctaactctagcaactttttcaactctttggctgttacgtgggtgaattgttttgcgatatttccttttttatctattatcaggtacatcggtaatcccgtcatctgaaaatgattccaaagataaccccactgttctttgttcaaccagtaatgttctccggcaatgtcttgtattagtatatcccaagtcttttttatagaattggggcctgtgaggtaaatgaaagcaactttgtcttcacctatttctttctttagtggttcatattccttgatgatttgccggcagccaccgcaccaggtagcccaaaagtcgataaactgtaccttccctttgtggtgggcaatgagagcagtcaacagttccttttccggaacttgtggtgcttcgcaaatagtgaatttctttgttatcgtttgctgtcggggttgcatctggcggttcatgtcttgaatgatacctaagaagataggattggtaatttccgaagccatgagctcttgtcggggtgtcagaggttgtaaattgtaaaaactggaacgcatatagattgctcgtatgtagtcaactattaaacttgtgctgtcttgtatgatattactaagacgttcttttgctttggagaatgactcccatctgaattggtcattttctttgaagtattttgcactaagtgccattagctcgctttcttgctgaaaggagatacctgctttgaaagccgtttcatattgatggataagtgtctgttcctctttagtgagtggtgcattttttaatagatttttttcgtaagcgagtgggtctttgtgggtatcatataaatccatgactacattgcggtaattataacaatagagtgctaaagggtgattgactgggaaatccttcaaataattgtggaaatcatcgggcaaatatacatcaagaaaagcagcaaaagcttgttcccgcgtaatgttttccttcttttgataagcagtttgcaggcaatagtgggtggcctgtagattttccaggcaatcaaatgcgcatgagagattggcgagtgtgcgagtgtcttcgctgaattgtaactgtgcgctgttgtgcgttacatatcgtttgtattggttgatacatcgttttttgaattcattggcactaatgcctacaatggaatccaataggtcgccatcactataaacaggtggtatctttgttatcagttccggctggcaccattcattgttaatggtagcatattggccgctaaatacaaactgttttcctggtggattacttagattgatagctacatttgtttctttttcgggacttagcagaatgactaaatcagcatttcctatcatcatccgtacttgtgtatgatggtagagaggaatattaatagtaaagcttccgtctgactcaacagtcggataaagagtttcggctgttcccatcacgatattgggagctccgatcttgaatatcagattgtcattcggatggtaattggcgattgtaccacttaaaatggcctttcctttctgatattcggggatgggtaattgtgcttgtgccaggttgaataacaaggacaaacaaagacaagtaaatagtctgttcatgttcatagtagttcttttattgcatttattatttctttatctgtattctcattactataacctctgattacttttcgtatgattcgttcttggtctactatgaaaaagtaaggtgcggcaccaccggtctgatattgtttgataacctcatttgttgcattcagaatggtataattcaattcctttcgctttgcgtaatttcggatagcagatactttacggctccaggattctattgcaatcagctcaaactcttcactggtgaatgattcttttagctgtttcaagaaggggatggctgcctgacaggcgccacaaccaatgcctgtgaagttgattagtatgattttgcttttgtagtcggctaatgataccggctgtgcttctatattttctaatatccagccgggagctttttttcctataagactggatgctgttggttctgcttttttcttgtagaggtcgctgtattttactatctcataatctttggggaaataatcagacgcgttaaagtcgtaaattgtgtgtctattgattgcaagatttgagcaagttgaaacggaaatatcatgcgacatctctcttcgttttttataaggcaggtcattcgacttgttgatccataactcataaatagaagttgtactgccgatatcgaatggaggaagtggcatgtgataagcttttccaaagaactcaacctgttgattctcatcaatgactaatttaaaataataattatcaccctcatctttcaactctgttacaatatgatccttagtggtaagtgcatatctgatgatattctttgcgtgattgaagaatggaggacttactagcctgaaaggaagtggtctgaatgtgaaatcatcaattgctaatttcttattttcgtgataaggtaatgctcttatgttgccgtcataacaaaattccagttttgttgtatcattggcatctagtgaaacataacttgctcctatggttgagtccattggattatcgtactctttaatgaagccgtgcaaggtagataatgcggttgaatcaccaggttgccagctttcgttggtgacatagtaggttgcagattcaatcttttctaaatcggtaagtactttctttaaatattctttttctgcgttttgtgcattggcggttattgtttctgccaataaaagaattgtaagtagtagtttaattttcataatgaataagtgtttgttggttcactggccggatttaatgtcttacaaatctacgaataattcgtaatatatctattttcagatggttaaataatatgaatatagattctaggaatcaatgatgattagttttagtagtatgaatcttatggtaagtgtttgtaaatggtttgttttattaatgtggctattgaagtgtcaatggagatctgaaaaaaaaacgttccccctttttcttaaaaacataagagaaaggaggaacgaagtttagttttcggttttacttaatgttattctttataccattgtgagtacatcaaataattgtgagcaatcttctgattcagttctttggcttgttcaggatctacctttttaatgaatttcgcgggtacccctccccaaatgcttcccggctcaatgatggtattgcttaataccagcgaaccggcggcaacgattgctccttcgccaactacgacgtgatccaggacggttgaccccatccctaccaatgcataatctttgatggtcgccccatgaatggtaacattatgccctacagatacatgatcgccaatttcaatagtcgatttctgatataatgtatgcaagacacttccatcttggatgttgacgctattgccaattcgtatggagttgacgtcacctcttaataccgtattaaaccaaatgctacaatcattttctatttttacatctcctataatagttgcattatctgcaaggaagcagttttctccgatttcgggagtaaaaccccgtactgatttaattaaagccatataatatttgtttctaataaagttttttatttaatgcagttctatgttgtacgacacccgggtgtcgtgatgtatgagacccgggtcttgagcagtctgacacccgggtctcagtatgcttgacacccgggtgtcagacaagttctttttaaagggaagcagttgcctcttgtaaccaaactttttcttcttcgttaagatccggtgacaacttctcgtagacagtctgatggtaattgtttaaccattcaatttcttcatttgtcagcatctccttgatgatcccttttttgcagattgggcataaagtgatagtttcaaacttaagatattctccaaacattccctctccatctttgcaaaccaacgtcaggttctccgtacgtatcccgtgactgcctgctttataaacaccaggctcattggaagtaaccatgccgggctgcaaaatgacagggttctcattcatacgaatgctttgcggcccttcgtgtacactcaggaaatgtccgacgccatgtcctgtgccatgaagaaaattcattctgtggttccagataggcatacgagctagtacatcgagctgggctccacgggttccggcagggaatttggccatagccaacgcgatgtgtccttttaatataagggtataatccgttttttcttcttctgtaagttcgcctaaggcaatggttcgggtgatgtcagtggttccgtccagatattgggctcctgaatctaagagtaagaaccctctgggctgaagagtcacctcactttccggggtagctgaataatgtacgattgccccatgttctttatatcctgcaatcgtgtcgaaactttcccccatgtagagaggctgtgcagccctaaactcatgcaactttttatctatacttaattctgtctcttttccggtagatacggattcttccagccatttgaggaatttgacgagtgctactccatcccgttgcatggcagcgtggatgccggcgacctcctgctcattgcgaatcgctttcaataatgcgacgggcgactcaccacgaagaatagaacattgcggattaatagatgaatagatagaataattcgttttccgtgggtcaatcagaatgttttttcccggaaaagaattcaggaatgtctctacctcatcatacttctgtattccaatctgccgttcctttagataagtctctacctctgccgtcactttctccggtgaaataaaataagtcacttcatcctgtgtgattaacaggtaacttactatgaccggattgcaatgtacatcgtttcctcgcaaattgagagtccatgcgatctcgtcgagcgcggatatgaataaagcatagacacctttctttttcaactccgtacggatggcggatattttctcttcacagctttttcctgcatatttgatatcataaataaaggcaggagaatcaggcatggcgggccggtttttccaaatgctactcaatggatctccaaatatgtcgacctgtaactgatgtgccgccagttcttctttcatctgttcgacctgttgcacagagaacattttcccgtcgatacttacagattctccaggttttaagtgttggcagagaaattctgtaatactgggagtctccggcaacatctctttatataaggtaatgccgctgccctccaattccttcgtagcttgcagaaaataacgtgagtcggtccataatcctgctttatccatcaggataaccgctgttccggcagaaccagtaaaaccggaaatccactcccgtgacatccagtggggagctacatattcactaagatgagggtcggtgctgggaataatgaacgctttgatagaattggaatgaaaggtcatgcgcagtgcatgcactcgctcttttatgctctgtttcatactttattatattattatagacatgtaagtgtttcaaaggtactaactttctgcatttaataacttgtttatgaatagtttttgagaaatatttgccgaaagttttgtgaataaagaaagtatgtgtaattttgcggcgcaatttgactgcggaattttttaatcataacatattaatagtaacaaaatgattgtagtacctgtaaaagaaggcgaaaacattgaaaaagcgctgaagaagttcaaaagaaaatttgaaaagactggcattgtaaaagagttgagaagcagacaacagtttgataaaccgtctgtaactaaaagacttaagaaagaacgcgcagtttacgtacaacaacttcagcaagtagaagattaataattcgtaatttcctttgaattattgaattcttttcatacattcgttgcacgattttagatgtagcgatattatgttgatagaatcttttcttgattatctccagtatgagcggaactattctgaaaaaaccgttcttgcgtacggtgaagatataaagcaactgcaggagtttgctcaggaagagtatggaaaatttaatccgttagaggtcgaggcggaactgattcgtgaatggattgtttcattgatggataaagggtatacctcaacttctgtaaatcgtaagctaagttcgctccgaacgttttacaagtatctcttgaggcagggagaaacgactatagatcctttgcgtaaagtaaaaggacctaaaaacaaaaagccgttgcctgtgttcttaaaagaaaacgaaatgaatcggttgttggatgaaacggactttggcgaaggatttaaaggctgtcgggatcggttgattattgaaatgttttatgctaccggcatgagactttcggaattgataggtctggataataaggatgtggatttttcggcttctcttctgaaagtgaccgggaaaagaaacaagcaacggctgattccgttcggtgacgaactgcaggagttgatgcttgaatatattaatgtaagaaacgaaacgattccggaaaggtcggaagctttctttattagagagaatggtgaacggctttataagaatctagtctataatttagtgaaacggaacctgtcaaaggtggcgacgttgaagaaaaagagccctcacgtgttgaggcatacttttgctaccacaatgctgaataatgaagcagagctgggggcggtaaaagaacttttgggtcacgagagcataacaactaccgagatctacacacatgccacatttgaagaacttaaaaaagtgtataaacaagctcatccaagagcttaaaaaaaggaggtaagtatggatgttagaattcaatcaattcactttgatgcgtcagagcaattgcaggcatttattcagaagaaagtgtccaagttggaaaaatattacgaagatataaagaaagtagaggtgtcattaaaggtaattaaaccagaagttgctgaaaacaaggaagcgggcattaaaatattaatcccaaatggagagttttatgcaagcaaagtatgcgatacatttgaagaagcaattgatttagatgtggaagcgctcggtaaacagctggttaaatacaaggaaaagcaacgtagcaaataaaaaaatcccaaatattttgcgggaaagaaataaataactaaatttgcagccgtttcgctcgcgttagaacgtgacggttgcattttttagtaaatttgcctctttagctcagttggccagagcacgtgatttgtaatctcggggtcgttggttcgaatccgacaagaggctcaaaaagaaaccgaagaacaaagatagaacatctgtctttatcatattgtttgaaaatagttcttttatttcttgattttgaaaagggcaaataccagagtggccaaatggggcagactgtaaatctgctggcttacgccttcggtggttcgaatccatctttgcccacaatcagagtgacaactttggcaagaatgcggaagtagctcagttgatagagcattagccttccaagctgagggtcgcgggtttgagccccgtcttccgctctcttttcttgctgttatagctcagtggtagagcacttccttggtaaggaagaggtcccgggttcaaatcccggtaacagctcataaaggatgtaaatgctgattattaatcaaataaataacaagtaaagctatggctaaagagaaatttgaacgtaccaaaccgcacgtaaacattggtacaatcggtcacgtagaccacggtaagacaacgttgacagctgctatcactactgtgttggcaaagaaaggtctttcagaattgcgttctttcgattctatcgacaacgctcctgaagaaaaagaaagaggtattactatcaatacttctcacgttgaatatcaaacagctaaccgtcactatgcacacgtagactgtccgggtcatgccgactacgtaaagaacatggtaactggtgctgctcagatggacggtgctatcatcgtttgtgctgcaactgatggtccgatgcctcaaactcgcgaacacatcctgttggctcgtcaggtaaacgtacctcgtctggttgtattcttgaacaagtgcgatatggtagacgacgaagaaatgttggaactcgttgaaatggaaatgagagaacttctttcattctatgatttcgatggtgacaatactcctatcatccgtggttctgctcttggcgcattgaatggtgttgaaaaatgggaagacaaagttatggaactgatggatgcagttgatacttggattccattgcctccgcgcgatgttgataaaccattcttgatgccggttgaagacgtgttctctatcacaggtcgtggtactgtagcaacaggtcgtatcgaaacaggtatcatccacgttggtgatgaaatcgaaatccttggtttaggtgaagataagaaatcagttgtaactggtgttgaaatgttccgtaaactgttggatcaaggtgaagctggtgacaacgtaggtcttttgcttcgtggtattgacaagaacgaaatcaaacgtggtatggttctttgtaaaccaggtcagattaaaccgcactctaaattcaaagctgaggtttatatcttgaagaaagaagaaggtggtcgtcacactccgttccacaacaaataccgtcctcagttctacttgcgtactatggactgtacaggtgaaatcactttgccggaaggaacagaaatggtaatgccgggtgataacgtaactattacagttgagttgatctacccagtagcattgaacccgggtcttcgtttcgctatccgcgaaggtggacgtacggtaggtgctggtcagattactgaaattatcgactaatacacaataattaatcagttcccggttttccatcgggaactgattatgtgcacacgggagtagctcagttggtagagcaccggtctccaaaaccgggtgtcgggagttcgagcctctcctcccgtgctaatattattgaaatgaaaaaggtaatagcttatattaaagaatcttacgacgaacttgtacataaagtatcgtggcctacgtattctgaacttgctaacagtgcagtagttgttttatatgcttccctgcttattgcattggtagtatggggtatggatgtctgtttccagaacttcatggaaaaaatcgtttatccacattaaaaaattaggaattgaaaatggctgagattgaaaagaaatggtacgttctacgtgctattagcggtaaagaagctaaggtaaaggaatatcttgaagctgatcttaagaacagcgaccttggtgaatatgtatctcaggtattgattcctactgaaaaagtttaccaggttcgcaatggtaaaaaaattgtgaaggaaagaagttatcttcctggctacgttttagtggaggctgctttggttggtgaggtcgctcatcacctgcgcaatactccgaatgtgataggctttttaggcggctccgaaaaaccggtgcctctcagacaatcagaagtgaatcgtatacttggtacagtggacgaactgcaggaaacgggtgaagaactcaatattccgtacgtagtgggagaaactgtaaaagttacttttggacctttcagcggattcagtggtatcattgaagaagtgaatagtgaaaaaaagaaactaaaggtcatggtaaagatattcgggcgcaaaacaccgcttgaattgggctttatgcaagtggaaaaggaataacacggaattgttacgctgttgttgttcttcgtttaatgtttatatataaatcaataaaaaaatggctaaagaagttgctggactaatcaagttacagattaaaggaggcgctgcaaatccatcacctcccgttggacctgctttgggttctaagggtattaatatcatggaattttgcaagcaattcaatgccagaacccaagacaaagcaggtaagattttacctgttatcattacttactacgcagataagtctttcgattttgtaatcaagactcctcccgttgctattcaattacttgaagtagctaaggtaaagagtggttctgctgagcctaaccgtaagaaagttgccgagcttacttgggaacaggttcgtacgattgctcaggacaaaatggttgacttaaactgttttactgtggaagctgccatgagaatggttgcaggtacagctagaagtatgggtatcgctgtaaaaggggagttcccggttaataactaataaacttcaattgtaatgggtaaactgacaaaaaatcaaaagttagctgcagaaaagattgaagcagggaaagcatactcactgaaagaagctgcatctttggtaaaagaaatcactttttccaagtttgatgcttcactggatattgatgtacgtttaggtgttgacccgcgtaaagctaaccagatggtgagaggtgttgtttcacttcctcatggtactggtaaagaagtgcgtgtgttggtactttgtacaccggatgctgaagctgctgcaaaagaagctggtgctgactacgttggtcttgacgaatatattgaaaagatcaaaggtggatggactgatattgatgtaatcatcactatgccatctatcatgggtaaaattggtgcgctcggtcgtgtactcggtcctcgtggattgatgccgaaccctaagagtggtactgtaactatggatgttgctaaggctgtaaaagaagtaaaacaaggtaagattgactttaaagttgataagagcggtatcgttcacacttctatcggtaaggtatcattcagtcctgatcagattcgcgacaacgcgaaagagttcatctctactctgaacaaactgaaaccgaccgcagcaaagggtacatatattaagagtatttatctttctagtacaatgagtgcgggtattaaaatcgacccgaaatcagtggatgaaatctaataaaacagagaaataatgagaaaggaagataaaagtacgattatagagcaaattgctgctacagtaaaggaatatggtcacttctacttggtagacgttacagctatgaacgctgctgctaccagtgcattgagaagagattgttttaaatcagacatcaaattgatgttggttaaaaacacactgcttcacaaagcacttgaaagtttggaagaagacttctcacctctttacggttctttgaaaggtactactgctgttatgtttagcaatactgcaaacgttcctgctaagttaatcaaagacaaagcgaaagacggtattcccggactgaaagctgcatatgcagaagaaagcttctacattggtgctgatcaattggatgctctcgtttcaatcaagagtaagaatgaagttatcgccgatatcgttgccctgttgcaatctccggccaagaatgttatttctgctcttcaatcaggtggtaacacccttcacggagttctcaagactcttggtgaacgtcccgaataattttcaaaaatcaacaaagtatttaaacaattaaaatcatacaaaaaatggcagatttgaaagcttttgcagaacaattagttaacttgacagtaaaagaagttaatgaacttgcaactatccttaaagaagaatacggtattgaacctgctgctgcagctgtagctgttgctgctggtcctgcagctggtgctgctgccgcagaagaaaaaacttctttcgacgtagtattgaagagcgctggtgcagctaaacttcaagtagttaaggccgttaaggaagcttgtggtcttggtttgaaagaagctaaagacttggtagacggtgctcctagcacagtaaaagaaggtttggctaaagacgaagcagaatcattgaagaaaacattggaagaagctggagctgaagttgaacttaaataacattggcctggtaatcaggtaattcggttaggaatccttcacaagaggattcttaacctttttgtgtatatatttcaaattaagttctccaaattcattgacagatgtcttcaaatactgtaaatcaaagagttaattttgcttcgactaagaatccgctagaatacccggatttcctggaagtacaattgaagtcattccaagactttctacaattagataccccacctgaaaagcgtaagaatgagggattgtataaagtatttgctgaaaacttccctattgccgatacaagaaacaattttgttcttgagtttctggactattatattgatccgccgcgttataccattgatgattgtatagagcgtgggcttacttatagtgttcccttaaaagcgaaacttaagctttactgtacggaccccgatcatgaggattttgatacagtgattcaggacgtattcctcggcccgattccttatatgactgataaggctactttcgtcattaacggtgccgaacgcgtagttgtgtcacagcttcaccgttctccgggtgtgttcttcggtcagagtgtacatgccaatggtacgaaactttattcggctcgtattattccgtttaagggttcgtggattgagtttgctactgacatcaataatgtgatgtacgcatacatcgaccgtaagaagaaattgccggtgactacattgttgcgtgcaattggcttcgagaatgacaaagatattcttgagattttcgatcttgcagaagatgtgaaggtaaacaagacaaatctgaagaaggtgttaggccgtaaactggctgcacgtgtcttgaaaacatggattgaagatttcgttgatgaagataccggtgaagtggtttctattgaacgtaacgaagttattatcgaccgtgaaaccgtactggaagaggagcatattgatgaaattttggagtcgggagttcagaacatccttttgcataaggatgaaccgaatcagtccgatttctctatcatatataatacgttgcagaaggacccgagtaactcggaaaaagaagctgtgttgtatatctaccgtcagttgcgtaatgccgatccggctgatgacgcaagtgcaagggaggttatcaacaacttgttcttctcagaaaaacgatatgaccttggtgatgtaggtcgttacagaatcaacaaaaagttgaatctgacgactgatatggacgtgcgtgtcctcacgaaggaagatattattgaaatcatcaaatatctgattgagttgattaactcaaaagcggatgtggatgatattgaccacttgagtaaccgtcgtgtacgtactgttggtgaacagctttctaatcagtttgctgtggggctggcacgtatgtctcgtacgattcgtgaacgtatgaacgttcgtgacaatgaagtgtttactccgattgatttgattaatgcgaagactatttcttcagtaatcaactcattcttcggaacgaacgcgttgtcgcagttcatggaccagacaaacccgctggctgaaattacgcacaaacgtcgtatgtctgcccttggtcctggtggtctttcccgtgaacgtgccggatttgaggttcgtgacgttcactatacacactatggtcgtctttgtccgattgagactcctgaaggtccgaacatcggtttgatttcttcattgtgtgtatttgcaaagattaatgagctaggattcattgaaactccctaccgcaaggtggaaaatgggaaagtggatctttctgataacggtttgatttatctgactgctgaagaagaggaagaaaaggttattgcgcagggaaatgctccgttgaatgacgatggtacattcgtacttaacagagttaagtctcgtcaagatgcagatttcccggttgttgaaccatctgaagttgacttgatggacgttgctcctcagcagattgcatctattgcagcttctttgattccattcttggaacatgacgatgctaaccgtgcattgatgggatcgaacatgatgcgccaggcggttcctttgttgagaagtgaagctccgatcgtaggtacaggtatcgaacgtcagttggtaagagactctcgtacccagattaccgcagaaggcgatggtgtggttgactatgtggatgctactactatccgtattttgtatgaccgtacggaagacgaagaatttgtaagtttcgaacctgctttgaaggaatatagaatacctaagttccgtaagactaaccagaacatgacgattgacttgcgtccgatttgtgacaaaggccagcgtgtgaagaaaggtgatatcttgactgaaggttattctactgaaaagggtgaattggcattgggtaagaacctgctggtagcttatatgccttggaagggttacaattatgaggatgccatcgtattgaatgaacgtgtggtacgcgaagacttgttgacttcggttcacgtagaggaatattcgctggaagttcgtgaaacaaaacgtggtatggaagagttgacttctgatatcccgaatgtaagtgaagaagctaccaaagacttggatgaaaacggtatcgtaagaatcggtgctcgtatcgagccgggtgatatcatgattggtaagattacgccgaagggtgaatctgatccttctccggaagaaaaactgcttcgggctatcttcggtgataaggcaggtgacgtgaaagatgcttctttgaaagcttctccttctttgaaaggtgtggtgattgataagaaacttttctcacgtgtgattaagaatcgtagctctaaactggccgataaagcattgttgcctaagattgatgatgaatttgaatctaaggtagctgacttgaaacgtatcctggttaagaaactgatgactttgactgaaggtaaggtttctcaaggtgtgaaagactatttgggtgcggaagttattgcgaaaggttctaagttcagtgcttctgattttgattcacttgactttacttctattcagttgagcaactggacaagtgacgatcatattaacggtatgattcgtgatctggtgatgaatttcattaagaaatataaagagctggatgctgaattgaaacgtaagaagtttgctattacaattggtgatgaacttcctgctggtattatccagatggcaaaagtatatattgctaagaaacgtaagattggtgtgggtgataagatggctggtcgccacggtaacaagggtattgtatcccgtgttgttcgtcaggaggatatgccgttcttggctgatggtactccggttgacattgtgttgaatccgttgggtgtgccttctcgtatgaacattggtcagatttttgaagctgtactcggacgtgccggaaaaacgttgggcgtgaaatttgcgactcctattttcgacggtgctaccatggaagatctggatcagtggacagacaaggcaggattgcctcgctactgtaagacttatctttgtgatggtggtacaggtgagcaatttgaccaggcagctactgtgggcgtaacttacatgttgaagttgggccacatggttgaagacaagatgcatgctcgttctatcggtccgtactcattgattactcagcaacctcttggtggtaaagctcaattcggtggtcagcgtttcggagaaatggaggtttgggcactcgaaggtttcggtgctgcccatatcttgcaggaaatcctgactatcaaatctgatgacgtggtaggacgttcgaaggcttatgaagcaattgtgaaaggtgaaccgatgccacaacctggtattccggaatccttgaacgtattgttgcacgagttgagaggtttaggtttgagtatcaacctagaataaaataatgaaagaatgtgagatgtcaatgtaccgatgaaggtctgttggcatccgcacttttttcaatttccaatgattcaattatcaaatctcaattatatagagtatggcttttagaaaagaaaataagacgaaaagtaatttctcgaagatctcaattggtctggcttctccggaagaaatccttgagaattcgagtggtgaagttttgaagcctgaaaccattaattaccgtacgtacaaacccgaacgtgacggtttgttctgcgagcgcatttttggtcctatcaaggattatgaatgtcattgcggtaaatacaagcgtatccgttataaaggtatcgtctgcgaccgttgtggtgtggaagttactgaaaagaaagtgcgccgtgaacgtatgggacatatccagctggttgtgccggtggctcacatctggtatttccgttcgcttcctaataaaatcggttatttgctcggattgccgacaaagaaactggattcgattatatactacgaacgttatgttgttattcagccgggtgtgaaagctgaagatggcgtagctgaatatgatttgctttctgaagaagaatatctggatattctggatactcttccgaaagacaatcagtatcttgaagataatgatccgaataaatttgttgcaaagatgggagccgaagctatctatgatttgctggctcgtttggatctggatgctttgtcttacgaactgcgtcaccgcgccggaaacgatgcgtctcagcaacgtaagaatgaagctttgaaacgtcttcaggtagtagaatcgttccgcgcatcacgtggacgtaacaaaccggaatggatgatcgtacgtatcgtaccggttattccgcccgaacttcgtccgttggttccgctggatggtggccgttttgctacatctgacttgaacgacctttatcgtcgtgtgattatccgtaacaaccgtttgaaacgactgattgaaatcaaggctccggaagtaatcttgcgtaatgaaaaacgtatgcttcaggaatctgtcgattctttgtttgataactcacgtaagtcaagtgctgtgaagacagatgccaaccgtccgttgaagtcattgtctgacagtttgaaaggtaaacagggacgtttccgtcagaacttgctgggtaaacgtgttgactactctgctcgttccgtaatcgtcgttggtccggaattgaagatgggtgaatgcggtattcctaaattgatggctgccgaattatacaagccgtttattattcgcaaactcatcgaacgtggtatcgttaagactgttaagtctgcaaagaaaatcgtagaccgcaaagagccggtgatttgggatatcttggaacatgtaatgaagggacacccggtactgttgaaccgtgctccgaccttgcaccgtttgggtattcaggctttccagcctaaaatgatcgaaggtaaagctatccagttgcacccgttggcatgtacggcattcaacgccgactttgacggtgaccagatggctgttcacttgcctttgagtaatgaagcaattcttgaagcacaaatgttgatgcttcaatcacataatatcttgaatccggcaaacggtgcgcctattactgtgcctgcacaggatatggttcttggtttgtactatattactaagttgcgtgccggtgcaaaaggtgaaggtttgacattctacggaccggaagaagcgttgatcgcttacaatgaaggtaaggtagatattcatgctccggtgaaggttatcgtgaaagacgttgatgaaaatggtaacattgtagacgtaatgcgcgaaacttcagtaggacgtgtgattgtgaatgaaatcgttccacctgaagctggttatatcaatacaattatctctaagaaatctcttcgtgatattattagtgatgtaattaaggtatgtggtgtggctaaggctgccgacttcctggatggaatcaagaatttaggttatcagatggcgttcaagggtggtttgtcattcaacttgggtgatattatcattccgaaggaaaaagaaactttggtacagaaaggttacgacgaagttgaacaagtcgtaaacaactataacatgggtttcattaccaataacgaacgttacaatcaggtaattgatatttggacacatgtgaactccgagttgtctaatatcctgatgaagactatttcttcggacgatcagggtttcaactctgtatatatgatgcttgactctggtgcccgtggttctaaagagcagattcgtcagttgtcaggtatgcgtggtttgatggcaaaaccgcagaaagcaggtgctgaaggtggtcagatcatcgagaacccgattttgtcgaactttaaagaaggactttcggtgttggagtactttatctctacccacggtgctcgtaaaggtttggcggataccgctttgaagactgccgatgctggttatttgactcgtcgtctggtggacgtatcacacgatgtgattattacagaagaagactgcggtacactccgcggattggtttgtacggaccttaagaataacgatgaggttattgctactctgtacgaacgtatcttaggccgtgtttccgtacatgatattattcatcctaccacaggtgaattgcttgttgccggtggtgaagaaatcacagaagaagtagccaagaagattcaggagtctccgatcgagagtgttgaaatccgttcggtattgacttgtgaagctaagaagggtgtttgtgctaaatgttacggacgtaacctggcaacgagccgcatggttcagaagggtgaagctgtcggtgtaatcgctgctcagtctattggtgagccgggtacacagttgacattgcgtacattccacgccggtggtactgctgcaaatattgcagctaacgccagtatcgttgctaaaaataatgcacgtcttgaatttgaagagttgcgtacagtagatatcgttgacgagatgggtgaatctgcaaaagtggtagtaggtcgtttggccgaagtacgttttgtggatgtgaataccggtatcgttctttctactcataacgtaccttatggttcaacactgtatgtaagcgacggcgatttggtagaaaaaggcaaactgattgctaagtgggacccgttcaatgctgttattatcacagaagcaaccggtaagatcgaatttgagggcgtgattgaaaacgttacttataaggttgaatcggatgaagcaacagggcttcgtgaaattattattattgaatccaaggataaaaccaaagttcctaccgctcatatcttaacagaggacggtgatttgatccgtacttataacttaccggtaggtggtcacgttatcatcgagaacggtcagaaggtaaaagccggtgaagtaatcgtgaagattccgcgtgccgtaggtaaggcgggtgatatcacgggtggtcttcctcgtgttactgaattgtttgaagctcgtaacccgtcaaatccggctgtcgtttctgaaatcgacggtgaggtgacaatgggtaagatcaaacgtggtaaccgtgaaatcatcgtaacttccaagacaggtgaggttaagaagtatctggttgcactgtctaagcagattctggtacaggaaaatgactatgtacgtgctggtactccgttgtctgacggtgctactactccggcagatatcttggcaatcaagggtcctacagctgtacaggaatatatcgtgaatgaagttcaggatgtataccgcttgcagggtgtgaagatcaatgataagcactttgagattatcgttcgtcagatgatgcgtaaagtacaaattgatgaaccgggagatactcgcttcctcgaacagcaagtcgtagacaaactggaattcatggaagaaaatgatcgtatctggggcaagaaagtcgtagtggatgctggtgattctcaaaatatgcaagctggacagattgtaactgcccgcaagttgcgtgatgagaatagtatgttgaaacgtcgtgacttgaaaccggttgaggttcgtgatgctgttgctgctacctctactcagatccttcaaggtatcacgcgtgctgctttgcaaacatcaagctttatgtcggctgcttccttccaggaaacaacgaaagtcttgaatgaagctgctattaacggtaagatcgataagcttgaaggtatgaaggaaaatgtgatctgtggtcacttgattcctgccggtaccggacagcgcgagttcgaaaagctcatcgttggatcaaaagaagagtatgaccgtatcttggctaacaagaaaacagtacttgactacaatgaagtagaataaatacaattcaattgactatatgaaaaggagcagttgcctgattgggcaattgctcctttttttatttcttttttactcgcgtgtattaccattagtttcaggaaaaatgtgttattttgcaggataactttttaatcatattaaatatggaagaacaaaataacaacggacaattacagattgaattgagagaagaggttgcacagggaacttatgctaatcttgctattattactcattcgagttctgaattcatccttgacttcgtgcgcgtaatgccgggcataccgaaggctggtgtgcaatctcgtattattgtggctccggagcacgcaaaacgtctgctgcgggcattagaagataatatagcaaagtatgagcgcgtattcggtccgattcgtacttcggatgaaccccctatttctcctttgacgggtgtaaaaggcgaagcgtgaggatgatataaaaacattaaaaaagaaaaaaaagttgtagtgcattgaatattcaaatattattcgtatttttgcagcccaaaatgtatagttacgaaattaatataacaataatataaatcaaaaaacaattaaaatgcctacaattcagcaattagtaagaaaaggacgcgaagtgctggtggagaaaagtaaatctccagccttggattcatgtcctcaaagacgtggcgtttgcgtgagagtatacactactactccgaagaagccgaactctgcaatgcgtaaagtagctcgtgtacgtttgactaaccaaaaagaggtgaactcatacattccgggagaaggacacaacttgcaggaacactcaatcgttttggtacgtggtggtcgtgtaaaagaccttccgggtgtgcgttatcacattgtacgtggtacacttgatacagcaggtgttgctggtcgtactcaaagacgttctaagtatggtgctaagcgtccgaaaccaggacaagctgctgctcctgctaagggtaagaaaaaataaggattaagacctaattaaaattaaagtaataacttacgttttagtttgttggaaatgctaaaggttgagtaaattctccggagggagagttgaagaagtcaagaagtagacaaccaagaacaaaaacattatttttcaaacaaatgagaaaagcaaaaccaaaaaaacgcctgattcttccggatcctgtgtttaatgaccaaaaggtttccaagttcgtgaaccacttgatgtatgatggaaagaaaaatacatcttatgaaatcttttatgccgctttggaaacagtgaaagcaaaacttcctaacgaagaaaaatcagctctcgaaatctggaaaaaggctttggataatgtaactccgcaagtggaagtaaagtctcgccgtgtaggtggtgctactttccaagttcctactgaaatccgtccggatcgtaaagaatcaatctctatgaagaatttgattctgtttgctcgcaaaagaggtggtaaatcaatggctgacaagttggctgctgaaattatggatgccttcaatgaacaaggcggtgcatacaagcgtaaagaagatatgcacagaatggcagaagctaaccgtgcatttgctcattttagattctaatactgtaagaaacctaatataaacttaaagtaaaggaattagaagatggctaaacatgatttacatttaactcgtaatatcggtatcatggctcacattgatgccggaaaaacaactacttctgaacgtatcctgttctacactggattgactcacaaaattggtgaagttcatgatggtgctgctactatggactggatggaacaggagcaagaacgtggtatcactattacatccgctgctacaacaacaagatggaaatatgctggtgatacttataaaattaacttgattgacactccgggacacgttgactttaccgcagaggtagaacgttcattgcgtatccttgatggagctgttgctgcttactgtgctgttggtggtgttgaacctcaatctgaaacagtatggcgtcaggctgataaatataacgttcctcgtattgcttatgttaataagatggaccgttctggtgctgacttctttgaagtagttcgccagatgaaggatgttcttggagctaatccatgtcctattgttgttcctatcggtgctgaagaatctttcaaaggtcttgttgatcttatcaaaatgaaagctatctattggcatgatgaaacaatgggagcagattatacagtagaggaaatccctgctaatcttatcgatgaagccaatgagtggagagataagatgcttgaaaaagttgctgaatttgatgatgctttgatggagaaatatttcgatgatccttctactattactgaagaagaagtgttgagagctcttcgtaatgcaacagttcagatggctgtagttcctatgctttgtggatcttctttcaagaacaagggcgttcagacattgcttgattatgtttgtgctttcttaccttctccacttgatacagagaatgtaataggtacaaatcctaatacaggagctgaagaagatcgtaaaccaagtgatgatgaaaaaacatcagctttggcgtttaagatcgcaactgacccgtatgtaggtcgtttgactttcttccgtgtctattcaggtaagattgaagcaggttcttatatctacaactctcgctctggtaagaaagaacgtgtttctcgtctgttccagatgcactctaacaagcagaatccagttgaagtaattggtgctggtgatattggtgcaggtgtaggttttaaagatattcacactggtgatactttgtgtgatgaaaatgctccgatcgtgctcgaatctatggacttcccggaaccggttatcggtatcgctgtagagcctaagactcagaaagatatggataaactgtctaacggtttggctaaattggctgaagaagacccgacatttactgtgaaaacagacgaacagacaggtcagacagttatttctggtatgggtgagcttcacttggatattatcattgaccgtttgaaacgtgaattcaaggtagaatgtaaccaaggtaagcctcaggttaactataaggaagctatcacgaagacagttaacttgcgtgaagtgtacaagaagcagtctggtggacgtggtaagtttgctgatatcattgtgaacattggtccggctgatgcggatttcactttaggtggtttgcagtttgttgatgaagtgaaaggtggtaatattcctaaggaatttattcctgcagttcagaaaggctttacaaatgctatgaagagtggtgttttggcaggctacccattggattcattgaaagtgactttggttgatggttcattccacccggttgactctgaccagttgtcatttgaaatctgtgcaatgcaggcttataaaaatgcatgtgctaaggcaggtcctgttttgatggaacctatcatgaaactggaagttgtaactccggaagaaaacatgggtgatgttatcggtgacttgaacaaacgtcgtggacaggttgaaggtatggaatctagccgctctggcgctcgtatcgtgaaagcgatggttccactggcggaaatgtttggttacgtaacagctttacgtactattacttctggtcgtgcaacctcatcaatgacctactctcatcacgctcagctttcttcttctattgctaaggctgtattggaagaagtaaaaggacgcgctgatttactctaaaatatctaaagcagcaggctagcgaatgactcttagcctgccgctttatcttattataaatgtattaattaaaaaaaagtaatgagtcagaaaattagaattaaattgaaatcttacgaccacaacttggttgacaagtcagctgagaaaattgtaagaactgtaaaagctacaggtgctatcgttagcggtccaatacctctgcctacgcacaaacgtatctttactgtgaaccgttcgactttcgtaaataaaaagtctcgtgagcaatttgaactctcttcttataagagattaatcgacatctatagctcaacagctaagacagtagatgctttgatgaagttggaattgccaagtggtgtggaagtagaaattaaagtttgataattaaaaattagtgaaatgccaggattattaggaaaaaaaatcggaatgacatccgttttcagtgccgatggtaaaaatgtaccatgcactgttatcgaagcaggtccttgtgttgttactcaagttaaaactgtagaaaaagatggctatgcagctgttcagttgggtttccaggacaaaaaggaaaaacatacaactaaaccgttgatgggacattttaaaagagcaggagtaacaccgaagagacacttggctgagttcaaagaatttgaaacagagttgaatttgggtgataccattactgtagaaatgtttaacgacgctagctttgttgacgttgttggtacttctaagggtaagggttttcagggtgtagtaaaaagacatggttttggtggtgtgggtcaagctactcacggtcagcataatcgcgctcgtaaaccaggttctatcggtgcttgttcttaccctgcaaaagtattcaaaggaatgcgcatgggtggacaacttggtggtgacagagtcactgtacaaaacttgcaggtattaaaagtaatcgcggatcataaccttcttttggttaaaggttctatcccgggttgcaaaggttcaatcgtattaattgagaaataatggaagttaacgtatataacattaaaggtgaagacactgggagaaaggttacgttaaacgaatctatcttcggaattgagcccaacgaccacgctatttatttggacgtaaaacaatttatggctaatcagcgtcagggtactcataagtcaaaagaaagaagtgaaatcagtggttcaactcgtaagatcggtcgtcagaaaggtggcggtggagcacgtcgtggtgatatgaactcacctgttcttgtaggtggtgctcgtgttttcggtccgaaaccaagagactacttctttaagttgaataaaaaagttaagacactggctcgtaagtcagctttgtcttataaagctcaaaacgatgcaatcgttgtcgttgaggatttcacatttgaagctcctaagacaaaagatttcgttgcaatgacaaaaaatcttaaagtttccgataaaaagctacttgtaattttaccggaagcaaataaaaacgtatatttgtcagctcgtaacatcgagggtgctaatgtacagactatctcaggattaaatacttacagagtattgaatgctggggttattgtgcttacagaaaactctctgaaggctattgacaatatcttaatttaaaaaggaggcttaaataatgggaattattattaaaccgttggtaacagagaaaatgactgcaatcacagataagctgaatcgtttcggctttgttgtacgtcctgaagctaacaaactggaaattaagaaggaaattgaagctctttataatgttactgtagttgatgtgaatactgtgaagtatgctggcaagaataagagccgttataccaaagcaggtatcatcaatggtcgtacgaatgctttcaaaaaagcaatcgtgacattgaaagaaggagatactattgatttttatagcaatatttaataaaaatggcagtacgtaaatttaagcccacaacaccggggcaaagacataaaattattggtactttcgaagaaattactgcatcagtaccagaaaagtctcttgtatatggtaagaaatcatctggtggtcgtaacagcgaaggtaagatgactatgcgctacattggtggcggtcatagaaaggtgattagaattgttgatttcaagagaaataaggacggtgttccagcagtagttaaaacaattgaatacgatccgaatcgttcggctcgtatcgctctgttattttacgctgatggagaaaaaagatatattattgctcccaatggattgcaagttggtgcgactctgatgtcaggtgaaacagcagcgccagagattggtaatgctcttcctcttcaaaacattccggtgggtactgtgattcacaatatcgaattacgtccgggacagggtgctgctctggttcgttcagctggtaactttgctcagttgacttctcgtgagggtaagtattgtgtaattaagttgccttcaggtgaagttagacagattcttagcacttgtaaagctactatcggtagtgtaggtaactctgatcatggattggaaagttcaggtaaagctggacgttctcgttggcaaggacgtcgtcctcgtaaccgtggtgttgtaatgaacccggttgatcacccgatgggtggtggtgaaggacgtgcttctggaggtcacccaagatcacgtaagggattgtacgctaagggacttaagactagagctcctaagaaacagtcgtctaagtacattattgagagaagaaaaaagtaatctgattaattgagtaaactatgagtcgttcattaaaaaaaggtccatatattaacgttaagcttgaaaagagaattcttgccatgaatgaatcaggtaagaaagtcgtagtaaagacttgggccagagcttcaatgatttcgcctgattttgtaggccatacagttgcagttcacaatggaaataaatttattcctgtttatgttaccgagaatatggtaggacacaagttgggcgaatttgctccaactcgtacattcagaggacacgctggtaacaagaaaagataacaggatttatttgaaataataaagtaataaataataatgggagcaagaaaaaaaatatcggctgaaaagagaaaagaagcccttaagaccatgtattttgcaaaattgcaaaatgttcctacttctccgcgtaagatgcgtctggttgcagacatgatccgtggtatggaagtgaacagagcacttggtgttttgaaattttcttcaaaagaagctgctgcaagagtggaaaaattgcttcgctctgcaattgctaactgggaacagaaaaacgaacgtaaagcggaaagtggcgagttgttcgtaacacagatttttgttgatggtggagctacactcaaaagaatgagaccggcaccacagggtagaggttatagaattcgcaaacgttcaaatcacgtaacattgttcgttggtgctaaaagtaataacgaagatcaaaattaaggtagatgggacaaaaagttaatccaataagcaaccgtttaggaattatcagaggatgggattctaactggtatggtggaaatgattacggtgattctttgctggaagatagcaaaatccgtaaatatcttaatgcaagacttgcaaaagcaagtgtatcaagaatcgtaattgaacgtacgctgaagctcgttactattactgtttgcactgctcgcccgggtattattatcggtaaaggtggccaagaagttgataagttaaaagaggagttgaagaaggttaccgacaaagatattcaaatcaatatctttgaagtgaagagaccggaactggatgctgtgattgttgctaacaacatcgctcgtcaggttgaaggtaaaattgcctatcgccgtgccatcaaaatggctatcgcaaacacaatgcgtatgggtgctgaaggtatcaaaattcagatttcaggacgtttgaatggagctgaaatggcccgttctgaaatgtataaagaaggaagaactccgttgcacactttcagagctgatatcgactactgtcatgcagaagcattgactaaagtaggtcttttaggtatcaaagtttggatttgtagaggtgaagtgtttggtaagaaagaattggctccgaactttacacaaagcaaagaaagtggtcgtggaaacaatagtggaaacaacggcggaaagaacttcaaaagaaagaaaaataatcgctaaacgaatttgaattttaggaaactatgttacaaccgaaaaagacaaaattcagaagacaacaaaaaggtcgtcagaaaggtaatgcccagagaggcaaccagctggcctttggttcttttggcataaaggctttggagactaagtggattacaggccgtcagatcgaagctgctcgtattgcagtaacaagatatatgcaacgtcaaggacagatctggatccgtatattcccggataaaccgatcactagaaaacctgccgatgtacgtatgggtaaaggtaaaggtgctccagagggatttgtggctcctgtgactccaggtagaatcattattgaagctgaaggagtatcttacgaaatcgcgaaagaagcattgcgcttagctgctcaaaagcttcctattacaacgaagtttgtcgtaagacgtgattatgatattcaaaatcaaaatgcgtaagtgttatgaaaattgcagaaataaaagaaatgactactaatgatttagtagaaagagtagaggcggaaacagctaattataaccaaatggttattaatcattctatttctcctttggaaaatcctgctcaaatcaaacaattacgcaggactattgcgcgtatgaaaacagaattgcgcgaaagagaacttaacaataaatgatcagcttgatggaagcaagaaatttaagaaaagaaagaacaggggttgtgttgagcaataagatggataagaccatcacagttgctgccaaatttaaggaaaaacaccctatatatggtaagttcgttagtaaaacgaagaagtaccatgctcacgatgaaaagaatgaatgcaatatcggtgatactgtaagcatcatggaaactcgtcctttgagcaagactaaaagatggagattagtagaaataattgaaagagctaagtaattatgatacaagtagaatccagacttacagtatgtgataacagtggagcgaaagaggcgttgtgtatccgcgttttgggtggtacaggtcgtcgttatgcttcagtgggggatgtcattgtagtttcagtaaagagtgttatcccttctagtgatgttaaaaaaggtgcagtatcaaaggctttgattgtacgtacaaagaaagaaatccgtcgtcctgatggttcttatatacgttttgatgataatgcttgcgtgttgttgaataatgcaggtgaaattagaggtagtcgtattttcggtcctgtagcaagagaacttcgtgctacaaacatgaaagttgtgtcacttgcgcctgaggtactttaatttgtaaaagatttaagtaatgagtaaattacatattaaaaaaggcgatacagtttacgtaaatgctggcgaagataagggcaaaactggtcgtgtattgaaggttcttgttaaagaaggacgtgcatttgtagaaggtatcaatatggtatctaaaagcacaaaaccgaatgctaagaatccgcaaggtggtatcgtgaagcaggaagcttctatccacatttcaaacttgaacccggttgatccaaaaactggtaaagcaacgcgtattgggagaaaaaagagttcggaaggaactttagtgcgttattctaaaaaatcaggagaggagattaagtaatgagtaatactgctagtcttaagaaagaatatgcagagcgtatagcacctgcattgaaatcacagttccagtattcttctacaatgcaggtacccgtacttaagaagattgttatcaatcaagggttaggtatggctgttgctgataagaagattatcgaagttgcaatcaatgaaatgacagctatcacaggtcagaaagctgtagctaccatttctcgtaaagatatcgcaaactttaagttgcgtaaaaaaatgccgattggtgttatggtaactttacgtcgtgaaagaatgtacgaattccttgaaaaattggttcgtgtagctcttcctcgtattcgtgacttcaaaggtatcgaaagtaagtttgatggtaaaggtaactatacccttggtattcaggaacaaatcattttccctgaaataaatatcgatagtattacaagaattctcggaatgaatattacctttgtaacctctgcggaaacagatgaagaaggttatgctttgctgaaggaattcggtttaccttttaaaaacgctaaaaaagactaatagatatggcaaaggaatcaatgaaagcacgtgaagtaaaacgtgctaaattagtagccaaatacgccgaaagaagagctgctttgaagcaaatcgtaagaacaggtgatcctgctgatgcttttgaagctgcacagaagttgcaagagttgccaaagaattctaatccgattcggatgcacaaccgttgcaaactgactggacgtcctaaaggttatattcgtcaattcggaatttcgagaattcaattccgtgagatggcatctaacggactgatcccaggcgtaaaaaaagcaagctggtaattattgtttaaatattgtcagggtagtcctgattaatttaatttatttttatatgactgatccaatagcagattatttaacgaggttgcggaacgcgattggtgcaaagcacagagttgttgaagttcccgcttcgaacttgaaaaaagaaatcactaagattctttttgaaaaaggctacattcttaattataagtttgtagaagatggtcctcaaggaactattaaggttgccttgaagtatgattctgttaacaaagttaacgcaatcaaaaagttagaaagaatatcttctccgggtatgcgtaagtatactggttacaaagatatgccgcgtgttattaatgggctgggtattgctataatatctacttccaaaggtgtaatgactaacaaagaggctgcagaactgaagatcggtggtgaagtcttgtgttatgtatattaattaggaggaattagaatgtcaagaataggaaaattacccattagtatccctgctggagtgacagtcactctgaaggataatgtggttaccgtaaagggacccaaaggcgaaatgagccaatatgtgaatcctgctatcaatgttgccattgaagacggacacgtaactttaacagaaaacgataaagaaatgcttgataacccaaagcaaaaacatgctttccacggtttgtatcgttctttggttcacaacatggttgtgggcgtatctgaaggatacaagaaggaactggaacttgttggtgtaggttatcgtgcttctaaccaaggtaacatcattgagcttgctttaggttatacacacaatattttcattcaattacctgctgaggtaaaagttgaaactaagtctgaaagaaataagaatcctcttattatattggaatcgtgtgacaaacaattgcttggtcaagtttgctctaaaatacgttctttccgtaagcctgaaccatacaagggtaaaggtattaagtttgttggcgaagtaattcgtagaaagtctggtaaatcagccggcgctaagtaattcatataaaattagattattatgacaacaaaaatagaaagacgagttaagatcaaatatagagtacgcaacaaaatttcaggtactactgaatgtccgcgtatgagtgtatttagaagtaacaagcaaatttatgtccagattatcgatgatctttctggtaagacactggctgccgcttcttctttaggtttgactgataaagttgctaaaaaagaacaagctgctaaagtgggtgaaatgattgctaaaaaggctcaggaagcaggtataactactgttgttttcgaccgtaatggttacttgtatcatgggagagtaaaagaagtagctgatgctgctcgtaacggtggacttaaattttaatcattatggcaggagttaataatagagttaagattactaacgatatagaactgaaagatagattagttgctattaatcgtgttactaaagttaccaaaggtggtagaacttttagtttctctgcaatcgttgttgtaggtaacgaagaaggtatcattggttggggacttggtaaagcaggtgaagtaacagctgctatcgctaaaggtgttgaatcagctaaaaagaacctggtgaaagtgcctattttgaaaggtactgttcctcatgaacaatcagctagatttggtggtgctgaagtattcatcaaacctgcatctcacggaactggtgttgtagctggtggtgctatgcgtgctgtattggaaagtgttggtgttactgacgttttggctaaatctaaaggttcttcaaatccgcacaaccttgttaaagctacaatcgaagctttaagtgaaatgcgtgatgcaagaatggttgctcagaacagaggtattagtgttgaaaaagtatttagaggataaggaggagatatgtcaactataaagattaaacaagttaaaagtagaattggtgctccagctgatcagaaaagaactctcgatgcactgggacttcgtaaactgaaccgtgtggttgaacacgaaagcactccttcaattcttgggatggtagataaagtaaaacacttggttgccattgttaagtaattatttgttgaataataaaacgaaattacaatatgaacttaagtaatttaaaacctgcagagggatctactaagacaagaaaaagaattggacgtggaactggttctggcttaggcggtacttctacaagaggtcataagggagctaaatcaagatctggatactctaagaagatcggttttgaaggtggtcagatgcctcttcaacgtcgagttcctaaatttggtttcaagaatatcaatcgtgtagaatataaagccatcaatctggatactatccagaaacttgctgaagctaagagtttggcaaaaattggtgtaaacgactttatcgaagcaggatttatatcttcaaatcagttggtaaaagtattgggtaacggaactctgactaacaagctggaagtagaagctcatgcattctctaagactgcaactgctgctattgaagctgctggtggaactgtagtaaaactctgattcaatgagaaaagctattgaaacattaaagaatatatggaagattgaggatctgagacagcggatcctcatcaccatattgtttgtggcaatttaccgtttcggatcatatgtcgtattaccgggtatcaatccggcaatgctggcaaaattgcacgaacaaacaagtgaaggccttttagccttgttaaatatgttctctggaggagcattttctaatgcctctatttttgcattaggaatcatgccttatatctctgcatctatcgtaatccagttgttgggaatcgctgtgccgtatttccagaagctgcaacgcgaaggtgagagcggcagaagaaaaatgaatcaatatactcgttatttgacgattgctatattgttagttcaggccccttcttatttgctcaatcttaaaatgcaggctggcccttccttaaatgcttcattagattggactctgtttatggttacctctaccattattttggcagcaggtagtatgtttattttgtggcttggtgaaagaattactgataaaggtattggtaacggtatttcatttatcatcttgattggtattatcgctcgtttccctgatgctttgttgcaagaagttgtatccagagtagcaaataagagtggtggtttgatcatgtttataattgaaatcgtattcttgttattagtgattggtgctgctattcttttggtacaaggtacaagaaagattcctgtacagtatgcaaaaagaattgttggtaacaagcaatatggtggtgctagacaatacattcctttgaaagtgaatgctgctggtgttatgcctatcatttttgctcaggcaatcatgtttattccaattacgtttatcggtttttcaaatgtaaatgatgcgggcggtttcttgcatgcgtttacagatcatacaagtttctggtataattttgtttttgcggtaatgattatattatttacatatttctatactgcaattacaattaatccgactcagatggctgaggatatgaagagaaataatggtttcatccctggtattaaaccgggaaagaaaacagcagagtatattgatgatataatgtctcgtattactttgccgggttctttcttcttggctttagttgctattatgcctgcttttgccggtatattcggagtgcaagcaggatttgctcaattcttcggcggtacatctttgttaattcttgtaggtgttgttcttgatacactgcaacaggttgaaagtcatttgttgatgagacactatgatggtctgttgaagtctggtcgtattaaaggacgcgctggtgtagcggcatattaattctttagattagaaatgatatttcttaaaacagaagatgaaatagaattgctccgtcagagtaacctgcttgttggtaaaactcttgcagaggttgccaaactggtgaagcctggtgtaactacacgtgagttggataaggttgctgaagagttcattagagatcatggggcaactccaactttcaaaggatttccgaatcaatatggagaaccatttcccgcatctctttgtacttctgttaatgagcaggttgtacatggaatcccaggggatattgtactgaaagatggcgatatcgtatcagtggattgcggaacttacatgaatggtttttgtggtgattctgcttatactttttgtgtaggagaggtggacgaagaaattcgtaacttgttgaaggtaactaaagaagcgttatatattggcattcagaacgcagtgcaaggcaaaagaatcggagacatcgggtatgctattcagcaatattgtgagtctcactcttatggtgtagtgcgtgagtttgttggtcatggcattggtaaagagatgcacgaagatcctcaagtgcctaattatggtaaaagaggatatggacctttgatgaaaagaggcctttgcatagcgatagagccgatgataacattgggagatcgacaagtgattatggaacgtgatggatggactgtgaggaccagagatcgtaaatgtgctgcacattttgaacatacgatagctgttggagctggtgaagctgatattttgtcttcattcaaattcatagaagaagttttaggagataaagcaatataatatggcaaagcaatctgcaatagaacaagatggagttatagttgaagcattgtcaaatgcaatgtttcgtgttgaattagaaaacggacatgagattactgcacatatttcaggtaagatgcggatgcattacatcaagatcttgccgggagataaagtgagagtcgaaatgtctccttacgacttatcgaaaggaagaattgtgtttagatataaataaaataagatatgaaagtaagagcatcattaaagaaacgcacgccagaatgtaagatcgttagacgtaatggccgtttgtatgttattaacaagaaaaatcctaagtataaacaacgtcaaggataatttgttatttttgcaaaaaaaataattaagtatatggctataagaatagttggtgtagatttacctcagaacaaaagaggtgaaattgcgttgacctatgtatatggaataggtcgcagtagttcagcaaaaattttagataaagctggtgtagataaagatctgaaggttaaagactggacagatgatcaagctgctaagattcgtgagattatcggtgcagagtataaagtggaaggtgatcttcgttctgaaatccaattgaacattaagcgattaatggatattggttgctatcgtggtgtacgtcaccgtattggtctgcctgttagaggtcagagcactaagaacaatgcacgtactcgtaaaggtagaaagaaaaccgttgctaataagaaaaaagctactaaataataattgttgatatggcaaaaaaaacagttgcagctaaaaagagaaatgtgaaagtagacgctaatggacagttgcatgttcattcatctttcaacaatattattgtttctcttgcaaacagtgaagggcagattatctcttggtcatctgctggtaaaatgggatttagaggttctaaaaagaatactccttatgcagcgcagatggctgcccaggattgtgcaaagattgcattcgatcttggcctgagaaaggtaaaagcatatgtgaagggtccaggtaacggacgtgagtctgctattagaactatccacggtgctggtatcgaagttactgaaatcattgacgtgactccgcttccacataatggttgtcgtcctccgaaaagacgtagagtttaatttacctttaacttacacaatgatcttgattttgtttttggattacatttaatttctctctgtaatcgcggctgcaacaaattaagttcatgaataaacaattaaatatttaaaagaaatggctagatatactggaccaaaatcgagaatcgcccgtaaattcggtgaaggaatctttggagctgacaaagttttgtcaaagaagaactatcctcccggacaacatggtaattcaagaaaaagaaaaacttctgaatatggtgtgcaacttcgtgaaaagcagaaagctaaatacacctatggagttttagaaaaacaattccgcaatttgtttgaaaaagcagctactgctaaaggtattaccggtgaggtactccttcaattgctggaaggccgtcttgacaacgtagtattccgtttgggaattgctcctacacgtgctgctgctcgtcagttggttagtcacaagcacattactgtagatggtgaagtggtaaacatcccttcatttgcagtaaaaccaggacaattgattggtgttcgtgaaagatctaaatctttggaagtaattgctaattctcttgcaggtttcaatcatagcaagtatgcttggttggaatgggacgaagcttctaaggttggtaaaatgttgcacatacctgaaagagcagacattcctgagaacattaaagaacatttgatcgttgaattgtattctaaataataattaatttcatggcgatattagcatttcaaaaacctgataaagtattaatgttggaggcggactccagattcggtaaattcgaattccgtccgttggaaccgggttttggtattactgtaggtaatgcattacgccgaatccttctttcttcattagagggttttgctatcactactatcagaatcgatggtgtggagcatgaattttctagtgtacctggagtaaaagaggatgttaccaacattatcttgaatctgaaacaagtgagattcaagcaagtagttgaagagttcgagagcgaaaaagtgagcatcactgtcgagaattccagtgaatttaaagcaggtgacataggtaagtatttgactggatttgaagtgttaaatccggaattagttatttgtcatttagattctaagtcaactatgcagattgatattacaattaacaaaggccgtggttatgtacctgctgatgagaatcgcgagtattgcacggatgttaatgtaattccaatcgactctatttatacaccgatacgtaatgtcaagtatgctgtagaaaacttccgtgtagaacagaagactgactacgaaaagctagtacttgaaattagtaccgacggttctatacatccgaaagaagcgctgaaagaagctgcaaaaattctgatttatcacttcatgttgttctctgacgagaagatcacgcttgaaagtaatgatactgatggcaatgaagagtttgatgaagaagtattgcacatgcgtcagctgttgaaaactaaactcgttgatatggacttgtcagttcgtgccctcaattgcttgaaggctgctgacgtagaaactctcggcgacttggtacaattcaacaaaactgacctgctaaaattcagaaacttcggaaagaaatcgcttaccgagcttgatgatttgctggaaagtctgaatctgtcgtttggaaccgacatttctaaatataaattagataaagaataaaaaatgagacataataaaaaattcaatcatttaggtcgtactgcttctcatagaagcgctatgttatctaacatggcttgctctttgatcaagcacaaaagaatcactacgactgttgcaaaggcgaaagctttgaaaaagtttgttgagcctttgattactaagtctaaagaagatactacgaactctcgtcgtgttgtatttagcaacttgcaagataagattgcagtaacagagctgttcaaagaaatctctgttaagattgctgatcgtccgggtggttatactcgtattatcaagactggtaaccgtttgggtgacaatgcagaaatgtgcttcatcgagttggttgactacaatgaaaacatggctaaagaaaaagttgctaagaaagctactcgtactcgtcgttcgaagaaagctgctgaagctgctcctgctgctgttgaagttcctgcaactgaagctcctaaggctgaagaaccaaaagctgaatcagctgaataattttacagttattcttatagatataaaaaaggctacctgtgagggtagccttttttgtttgtctgccgtttactaatactaagatacattaaaatatatcttaatagaacttttcatagagagaatctgttatatttgcaggtgaatatggcaaaatttgtaaaggtaatattgtttctgttgctgactgttgcttttcatagcatagcaggcaatgtttctactgcgaaagtggtggatgaacaggagcgtgctattacatatgcaatgagacagcatggggaaatcagcgcaccggatcttcctggtaagccagtggctgaattgaacaacttgcaaagccatcagatatctgtaacacgtattcaacgtgtgcaacttggagaatatttcttttctttaaaaaatgcgctacaatgttgtgctgatcgtgataactcactttcacaacactgggggcggatttatggtacaacaacttcctattattgccagccatcaagtgaatactatgtatatactttgaggcgtataattatttagtagtctatttattggtattgtttattttgtggttactggtatcttctgtaataccggtgactatattctttttatctttatatttttactaataatttaaactttaaatattatggcaactattcaaacgattgatgctactatcttcgcatcttcacaccccgatatcgcaaaacgtacaagtgtttcaggagttttaatttcttctgtaatgttattggtcggtattttagcttttgcttctactttcgaattggaagataagtcttctacggttagtatggctttgatggttctgggaacaggtttattccttatggggattttccgtctcttctggaaatcaaaagaagttatttatttgccaaccaaaagtgtggctaaagagcatagtatattctttgatttgaaacacatggatgctttgaggaatcttgtgaattcgggttcattctctgcaggttcgaatataaagagtgaggctagtggtaatatacgtatggatgtgatactttctgctgataaaaagtttgcagctgtacagttattccagtttataccttatacatatcagccaataacatcagtgcagtatttcactgatgaacaagcttcagcggtaatagcatttctggcaaaaagtaaaatgcagtaaaagtatatctacaaaacctgtttaactttgttttttccgacacattaaaacaggtagcttgaaattttatattcagtttgctgctactaaataaagccggttttggatgttactgcaatagaaaactttgattttcatacaaggatggggattagtcgttaatgacggcgatccccattttcttcattaaaaagcaggcattcatattttgcgcaactccatttctcatttggtaagagaaggtgagttcgttgttcgtgatgtcagcttcgaaacagtaattccggatattttgtgggaaagagtccactaaagttcctagcaacaagtcatgagtggcgatgatgccattggtgttcatgtgcatgaattgtttgatgagggcgaaagaacctttctgtttatccatagagtttgtacctttcaatatttcatcaaggatgatgaaaagttcttctcctgcttcaagcttgtctatgattaatttaagtcgcttgagttcggcaaagaaataagattcgttgtcggctaaggagtcactggtccgaaggctggtgacgaggcgagccggatatatttccatccgctttgcccaaacgggagcccctatacatgctagtagatagttcactcctacagtacgtaaatacgtgctttttcctgccatattggctcctgtgataataataaagaaaggacgtctttcaatgtttattccgttgcgtacacatttgttgcgatccattaaaggatgccccaaagcttcagcctgcagatggaaagattgagcagcaatggtaggatagatgtaatccggatgattatatgcgaatgttgccagagaacaataagcgtcaatttctccgatggtttctatccagcggggaaggtcagatgcgtggatttctttccacttctcgattcgcatcacttggcgcagctcccagaatatcagtccattgagtatcgtgcttattagcagattgcttcgttgatcgagcgcgttcatcagttttgaaagctggcgtactgcttgagaagcggtttgattctgacttgtaagttccgtttttaacttttgcagtatatgactttgcatttctttctgttcagtgagaagaatctggtcagcgtatgtcgaaagaatttgtagcttttctccgtaggtcgtttgtagtttagtgattcctttagaaaaaatagtgctgaataatacaaagccaacaaacactcctcctgcaatactggccgagataatacctaaaatggctagacctatacataagaaattaatgatcgttaccgctgtcgggaggatgcgtagaagtgtacgcttccgataataacttggactgtttgcccattctttgatttcggtggtatcggcaggttttcctttatagagtaagccgagtaagcggatttgttggcgatattctaagtctgtggacaattcatgtatagcttcctggcgatgttcaatagcttctttgttttccagatgtgcattgaaccagtttgcaagatgcagtttgccaataggcgttgcagtgcggttgatgtattggaaaagagaatgttcgccaaatacgtctaaatcaagagtgtagagatgagatggattaacaaattcttttccatcatcaaaatcagaaaagtcatattgcatggcacgtagctcctgctcattgatttctattttctttttcagaaagtcttttcggtagaaccagaaattatggcgttttaccagccagatgaataagataaaaggtaagatagcgaaagcagagagacatagccacccatcagaccaaaagataatagcatttgctacagctcctacgaataagatcaggcggagaagactgatataatagatacgtttccgtgcattctgtaactccagttctgttttctgaatgatttgctgatatgtagtaatgatctgttcttgtttttccatgacaaatttaattcttttccacaaaggtaatataattcatgacggtcgggataagagcttgtttttgtcgagagcagatttactgtttattaacggaagatagaaaggaataacaagctcatattatgacttgtctggataatgcctttattagctgtaaggaatggggtatataagttctgttttcgtttaataagagtagggggcatttcctgatagcagctttttttcaatatttctttcctcattcttgcatttatccgctaaaatttataactttccactcgaaaaggcgttagacaggaaaggaggatgcttatgaagaaaggatgtatcttatgtttgctgataagcgtgattagccttccgttaattgcgcagaatattatttattccaacctgaaagagttgctggctcaacatggtgatacaatagccgtgttgcgtgtagaaaaacgttccagaaatcagattgtattgacaggaggggctgattaccggataacggccggtgatgacgagtcgatgtgtcgacgcttgaagaagcgttgttttgccgtgcgtgacgaaaaaggagatttatatttgaattgtcgtaagttgcgctataaaaagttacgctttggagcatggtatgcccctgccgttcaattgggtaaaaatatctatttttgtgccatgcctctaggttcggttatcggaggaaactttgtagaagaggatgacgtaaaactgggagggaatattggcgatgctcttgccgcttcaagtttggttacgaaacgcgtctgttatgagctaaatggtgaaacaggaaaagtcgattttctaggaaaagataaaatgcttcaattattgaagaattatccggaactgaaacaggcatatttgaaagatgatagtcaggaggcgaagcatacctttaaatatttgttggagttgcggaataaacaaaaaaagtaattttgtcgatctctgttggtatagcagagaaagagtatgttcataatacaatcatggtcatagtgatatgattagggtgcggattatgcaaataacacagaactcatagctttgatttaatggaaaaatccgctatccattttaataaaagccctattagtccgtttggataaaagacctgcatttgtatctgtataaaagcataagagactcctgacattgcctgtatcttaccattctattaagcagtaaatgtaataatgcctttctgataataaatctgttatttctcttgtcttttatcttctttttttctatattgcgaagagttataagactgtattgcttacagtttgtaatccttaattctgtttattatgagaataactcttggcaacacgctacctccttatccggattttgtagaaggtatccggagagctcccgaccgtggttatacacttaccccggcgcagaccatcacagctttaaaaaacgctttgcgttatattccctccgagtggcacgaacaactggctcctgaatttatggaagaactacgcactcgcgggcggatttacggataccatttccgtcctgccggagacttgaaagcaaagccgattgatgaatatcaggggcaatgtattgaaggcaaagcctttcaggtaatgattgacaataacctttgcttcgatatagccttatatccctacgaacttgttacttatggtgaaaccgggcaagtttgccaaaattggatgcaatatcgactgattaagcaatatctggaagaacttacccaggaacagacactggttattgaatccggacatccattggggcttttccgctcccgtcccgatgctccccgcgttataattaccaattcgatgatgatcggacaattcgacaatcaacatgattggcatattgccgcccagatgggagttgccaattacggacagatgacagctggtggttggatgtatatcggtcctcaaggcattgtgcatggcactttcaacaccctcctgaatgccggacgattgaaactcggaattccacaagaccaagatttgcggggacacttatttatttcttccggtttgggaggaatgagtggtgcacaacctaaagctgccgaaatagcaggagcagtctccatcatagccgaagtagatcgttcacgcattgaaacacgttaccaccagggatgggtggggcatgtgactgcagatatcatagaagcataccggatggcagctgaagcaatgcgacgccgtgaaccttgttccattgcctatcatggaaatatagtagacctgctcgagtatgccgagcgtgaaaagattttgatcgaactattatccgatcaaacctcctgtcacgccgtttacgaaggtggatactgcccagccggactgactttcgaggaacgcacacgccttcttcacgaatcgccggaggaattccgtcacttggtagacatatctttgcaccgtcatttcgaggtcatcaagaaattggtagcccgcggaacttatttctttgattatggaaactctttcatgaaagccatatacgatgccggagtaaaagaaatctcctataatggtgttgatgaaaaagacggatttatctggccgagttatgtcgaagatattatgggaccccaactctttgattacggctacggtccgttcaggtgggtctgcttgagtggtaaacacgaagatctgataaaaacagaccatgcggctatggagtgtatcgacgtcaatcggcgcggtcaggatctggacaactataattggatacgggatgcagaaaagaatcaactcgtggtgggtacacaggcacgtattctttatcaggatgcagttggaagaatgaagatagccctccatttcaatgagatggttcgccggggtgaagtaggccctattatgctgggacgagatcaccacgatgtcagcggtacggattctcctttccgggagacgtcaaatatcaaagacggaagtaatgtgatggcagatatggctgtgcaatgctttgccggaaattgtgcccgtgggatgagtctggtagccttgcataatggaggtggagtcggtatcagcaaagcaatcaatggcggttttggtatggtatgcgacggtagcgaacgggtagatgaaatactccgttcggcaatgctttgggacgtaatgggaggagtagcccgccgttcgtgggcgcgtaatccgcatgcgatggaaacgagtgaagcatttaatgagtcccatgctggagattatcagataacaatgccgtatgtggcggacgaagaattaataaagaagatagttccatctattgtgggaaagtagtctcacaatataagagaaagcgttcccataatgtgaaggaataaattcccacaatatatggaacagtttgaacatgctgttattttggataaaccatgtggctatttgatgtaaaacatatagttattcagtaaagtataacctctataataatagatatttgatatgagttggaataagataattgaatgtgtccccaattttagcgagggacgtgatttggagaaaatagatcagatagtagcccctttccgtagtaaagccggagtaaaactgcttgattacagtaatgatgaagatcataaccgtctggttgtcacacttgtgggagagctggaagcactgtgtgaagcagtagttgaagccgttggtgtagctgtccgtttgatcgacctgaatcagcacaccgggcaacatcctcgtatgggagcggtagatgtaattcctttcatcccgattaagaacaccagtatggaagaagccatcgaactctctaaaaaagtagcggcgaaagttgcggagctatataatcttcccgtcttcctgtatgaaaagtcggctactgcgccacaccgggaaaatctcgcctccgttcgtaaaggcgagtttgaaggaatggccgaaaagatcaaactacccgaatggcaacctgacttcggacctgctgaacgacatccgaccgcaggtaccgtagcaatcggagcccgtatgccactcgtagcttacaatattaatctaagtacagataatatggagatagccactaagatagcgaaaaatatccgccatatcaatggaggacttcgttatgtaaaagcaatgggagtggaactgaaagagcgaaacattacccaagtatccattaacatgaccgactatacccgtaccgcactctaccgtgccttcgaattagtacgtatcgaagcccgtcgttacggtgttacgattgtaggtagtgaaataatcggtcttgtaccgatggaagctctgattgataccgcttcctactatctcggactcgaaaactttaccatgcagcaagttcttgaagctcgtatcatggaatagtcaataagaaaatagaatgaatcacaattgctttatggcaaacatcattctaaaagaacgtgccattcatatctccatttattatatgaactaattatgatgaactatttatgagtgaaaacctaatcatatttaacgcccgtatcgtaacccccatcggcttttccgcccgtaaaggagaggaaatgtctcaactgcaaatcatagaaaacggaaccgtggaagtgaccaaaggaatcattacctacgttggtgaaaaccgtggtgaagatcgggatggttactaccagcactattggcattataacgctcgcgggcattgccttttacccggtttcgtcgactcccatacccattttgtatttggcggagaacgttccgaagaattatcctggcgtctgaaaggcgaaagctatatgtcaatcatggagcggggagggggaattgcaagtaccgtcaaagccacccggcaaatgaactaccttaaacttcgttcagccgccgaaagcttcctgaagaagatgagcaccatgggagtaaccaccgtagaaggtaaaagtggctacggcctggatcgggacacagaattactacaactaaaagtaatgcgcagcctgaataacgccgagcataaacgcgttgatatagtctccactttcctcggcgcccacgcccttcccgaagaatatgcagggagaagcgacgaatacatcgatttcctgattcgtgaaatgcttccccttatccattccggtaagtgggcagaatgttgtgatgtcttttgcgaacaaggcgttttctctatcgaacaatcccgtcgcctgcttcaggcagccaaagagcacggtttcctgttgaaactccatgccgacgaaatcgtctctctcggcggtgccgaactggcagccgaactcggagcactgtctgccgaccatctcctgcacgcttccgatgccggtatccgtgcaatggccgatgccggagtagtagccaccctgttgcctctgacagctttcgctttgaaagaaccctacgcgcgaggtcgtgaaatgattgacgtcggttgtgctgtggcacttgccaccgacctgaatcccggcagttgtttctccggttccatcccgctgaccattgctctggcctgcatctatatgcaaatgagcatcgaagaaaccatcactgctctcaccctgaacggagccgccgcccttcaacgagccgaccgtattggaagtatcgaagtaggtaaacaaggcgatttcgtcattctcaattccgacaactatcatattctaccttactatataggcatgaattgcgtaatcatgactattaaaggcggcatactttatcccgtcgcttaatagttgaaaaactctcattcattaatcacttaaaaaacagaataccatgttagcagatttaaccgtaaaagatttcttagataaagtagcttgcagtgaccctgtgcccggtggcggtagtattgccgctttgaatggagcgctggcttcctccctttctacgatggtggcacggctgaccgtaggaaaaaaaggatacgaagtcagtgaagaagtaatgcagcacgcacaaaccatcaccctccgtttgctggacgaatttatggcgcttattgacaaagattcagctgcctacaacgaagtatttgcctgctttaaactacctaaaacaaccgacgaagagaaagccgcccgaagtgctgctatccagaaggcaaccaaacaagccgccctcgttccgttggaagtagcccgcaaagcactggatatgatgtccgttatagcagatgttgcccgtctcggtaaccggaatgctgtcacagatgcctgtgtagcaatgatgtccgcccgtaccgccgtattgggagccttactgaatgtccgtatcaacctcggttcgctcaaagacagagattttgtcctccagctgcaaaccgaagccgatgccatcgagcaaaccgcctgtcagagagaaaaagatttgttggatgccgtaaatcaagacctgcgcgtatgagtaagaatgtataccatatcggttccggagcactgaccttcgaaatcatcgaacgaattataaacgaaaacctgaaactggaactagcccccgaagccaagttacgcatccagaaatgccgtgactacctcgaccaaaaaatagcttcttccgaagaaccattatacggcataacaacaggtttcggctctctatgcactaaaaatatatctcccgatgaactgggaaccctccaggagaacttgataaaaagccatgcttgcagcgtaggcgaagaaatccgccccgtcatcatcaaactgatgatgcttctcaaagcccacgccctctcattgggacatagcggcgtacaagttatcaccgtgcaacgcatcctcgattttttcaataatgacgtcatgccaattgtctacgaccgcggttcccttggagcctccggcgacctggcaccgctcgccaatcttttccttcctctgataggtgtcggtgatgtctactataaaggaaaaaagtgcgaagccatcagcgtactcgacgagtttggctgggaaccggtcaaactaatgagcaaagaaggactagccctgctgaacggcacccaatttatgagtgccaacggtgtgtttgctatgctcaaagcctttcgcctctcgaaaaaggccgacctgatagccgccctttccctcgaagcctttgacggccgtatcgacccgtttatggactgcatccagcaaatccgtccccatcagggacagattgagacaggcgaagccttccgcaaactactggcaggcagcgaactaatcgaacgccacaaggaacatgtgcaagatccctattccttccgctgcatcccacaagtacatggcgccaccaaagatgccatccgttacgttgcctccgtactgctgaccgaaatcaattccgtcacggacaaccccaccatcttccccgatgaagaccggatcatctccggcggaaactttcacgggcaaccgcttgccatctcttatgacttcctcgccatcgccctggccgaattgggaaatatctccgaacgccgtgtctcccaactgattatgggactccgtggactacctgaatttctcgtagctaaccccggtctgaactccggattcatgattccccagtatgccgccgcctccatggtcagccagaataaaatgtactgctatgcagcttctagcgattccatagtctcctccaacggacaggaagaccatgtaagcatgggtgccaatgccgccaccaaactctataaagtgatggacaacctggaacatatccttgccatcgaactgatgaacgccgcacaaggcatcgacttccgccgcccgcagaaaacctctcccgttcttgagcgtttcctccatgcctatcggaaagaagtgccttttgtaaaagatgacattgtgatgtacaaggaaatacataaaacagtcgccttcctgaagaggacacagattgaatactgacaataaattgaccctttttcgcttttcgttaataatggtgactgttattgccggttaagtgtcgattcttatcgatatttatccggcatttattggctcccatctcttctattagcgataaaactttacttcctatattccctccttttacctttcttttgtgtttgttccaaatttcctattaacacttgttttcatttcactctattgaatgataataaatcccaaatggactataaatagctggaaacttaatttgctaattgagttttctatatatctttgttccgtttttcctttggaaatgaagagaaaacgaaaactgcattttaataaaatagaaaaacggatgatgacagagcatggaaaggacgcttcccaacgggtagagttaagagaacggatcataacggcggcaacagaagcttttacttcaaaaggcatcaagagtattacaatggatgacattgcagcagcattaggaatttccaaacgtacgctctacgaagtcttttcggataaagaatcgttgttgaaagaatgcatactgaaggcacaggcagacagagacaagtatttgcagaaagtctttgaacagtcgcacaatgtgttggaagtgatacttgcagtctttcagaaaagcattgagatgtttcatcagacgaacaaacgcttttttgaagacattaagaaatatcccaaagtatatgagatgatgaagaatcggcaggacagcgattcgatgaaaaccatgtccttcttcaaaacaggagtagagcagggcatctttcgttcggatgtaaacttcgctattgtcaatttgctggtacgtgagcaatttgatgtgcttttgaatacggacatctgtaatgaataccctttcattgaagtgtacgaatccatcatgtttacttatatacgcggtatctccaccgaaaaaggagcaagggtactggaagactttatacaagaatatcgcaagaaccgcatcgaagactagagtaaaagtgaggttctattgacaaacaattaagattaaattagaaattcagtttatgaacaagatgaaaagattgacaggtcggaagatccttctggtagctgtggcattctgtgcatttggttttgcaaaggcgcaggacacgcagacggagaagaataccctaaccttaaccttagacaaagccttggaaattgcattggatgagaatccgacaatgaaagtggcagcggaagaaatcgccttaaagagagttgccagcaaggaagcctggcaaagtctgttgccggaggccagcattgccggttccttagaccatacaattaaagcggctgaaatgaaattgaacgatatgtcgttcaagatggggcaagacggttcgaacaccgccaatgccgggttgagtattaacctgccactctttgtgccgggtgtttaccgtgctatgtcgatgacaaagacggatattgaactggcagtagagaagtcacgtgcttccaaactggatctggtgaatcaggtaagcaaggcttattatcagttaatgcttgcacaggatagctatgaagtgcttcaaggcagctataaactggcagaagataattacaatgtagtgaatgccaaatatcagcagggaactgtgagcgaatatgacaagatcagtgcggaagtacagatgcgcagcattaagccgaacctgattgcggcagccaatgcggtgactttggctaaattacagttaaaagttctgatgggcatcactgccgatgtggagataaagattaatgataatctgaccaactatgagacgaccatgtttgccaatcagttgaaagaagagaatgtgaatctgaacaacaataccaccatgaagcagttggacttgaacatgaagttgctcgaaaagaatgtaaagtctttaaagacgaactttatgccgactctttccatgagcttctcctatcaatatcagtcattgtataatccgaatatcaatttcttcgattataactggagcaacagttccagcctgatgttcaatatcagcatacctttatataaggcaagcaattttacgaaagtgaaatctgcccgtatccagatgcgccagctcgattggaatcgtatcgatacggaaagacagttgaatatgcagattgtcagttgtcgcaataatatgagtgccagcacagagcaggtagtcagcaacaaggaaaatgtgatgcaggcaaagaaagcggtggtgattgccgaaaaacgttatgatgtaggtaagggcacggtgctcgaactgaacagttcccaagtgtcactgacacaggcgcaactcacctacaatcagtccatatacgattacctggttgctaaggcagacctcgatcaggttctgggaaaagaataaagatagacaactaaaaaattacaagtaaggaatatgaaaagaagtatccaattggtagccctgctgttaactgtgtttatgggctcatgtacaggtggaaaagacaaagctgctgcggaacatgtggacgcaaagcctattgtgaagctggcagacgtaaaagcccgccccgtagatcaaatacaggattacacagcaacggtggaagccgaagtaaagaataatattgcgccttcgtctcccgtacgtatcgatcagattttcgtagaagtgggcgaccgcgtatccaaaggacagaaacttgtgcagatggatgcagccaacctgaaacagacgaagctgcaactagataatcaggaaatagagttcagccgtatcgacgaactatataaagtgggcggtgcgtccaaatcagaatgggatgcttcgaagatgcaactcgatgtgaagaaaaccgcttataagaatttgctggagaatacctctttgcaaagccctatcaatggtgtagtgactgcacgcaactatgataacggcgatatgtacagtggtggagaaccggttctggtagtagagcagatcactccggtgaagctcctgattaacgtgtccgaaacctacttcacgaaagtgaaaaaaggtacccctgtcgatgtgaaactcgatgtatatggcgatgaagtatttacaggaaccatcaatctgatttacccgactatagatgctactacccgtacattccaggtagagatcagactggataataaagaccagcgtgtgcgtccgggaatgtttgcccgtgcgacattgaacttcggtacagcagaaaacgtagttgttcctgatttggctatcgctaagcaggcaggttccggcgaccgttatgtattcgtttataaagacggtaaagtatcttataataaggttgaactgggtagacgcatgggtacggagtacgagttgaaatccggtgtgcccgataactcacaggttgtagttgccggacagtcacgtttggtgaacggtatggaagtagaggtggaagcctcttcccaactttcttccaaatgagagatgtacagtacctttctcccaatgcttttattaattaacctgatttcaaaacgatcttccggcttcctcttcttgggagaggagtggggagaggcttttaaataaaacaacatgagtttatacgaaggtgcggttaagaaaccgattatgacctccctctgctttctggcagtggtgatttttggtcttttctctttgtccaagttacctatcgacttgtatccggacattgacacgaatacaatcatggtaatgaccgcttatcccggagcaagtgcttcggatatagaaaataatgtgactcgcccgctcgaaaatacgttgaatgcggtgagcaacctgaaacatatcacctcccgttcttccgagaatatgtcattaattacattggagttcgagtttggtaacgatattgacgttctcaccaatgatgtgcgcgataaactcgacatggtaagctcacagcttcccgatgatgtcgagaatccgatcatcttcaaatttagtacggacatgattccgatcgtgttgctttccgtacaggccaatgagagtcagtcagcgctttataagatattggacgaccgtgtggtaaatccgctggcacgtattccgggagtcggaaccgtctccatcagtggtgcaccgcaacgtgagattcaggtatattgcgaccccaacaaactggaagcctatcacctgactattgaaacaatcagctccattatcggagccgagaataagaacattcccggtggtaacttcgatattggtagcgaaacctatgcactgcgtgtagaaggtgagtttgatgattcccgtcagttggcagatgtagtggtgggtacacacaatggggcgaatgtctttttgcgtgatgtagcccgtattgtcgataccgtggaagaacgtgcgcaggaaacctataataatggtgtgcaaggtgctatgattgtagttcagaaacagtcgggagccaattcggtagaaatctccaagaaagtggccgacgcgctgccgaggcttcaaaagaacctgccgagcgacgtgaagattggtgtcattgtcgatacctcggacaacattttgaacaccatcgacagtttgacggaaaccgttgtttatgccttgctctttgttgtcatcgtcgtgttcctcttcctgggacgttggcgtgcgacgctgattatctgtatcactattccgctttcgttgattgcttcgttcatttacttggcgattagtggaaatacgattaatattatttcgctttcgtcactttctattgctatcggtatggtggtggatgatgcgattgtggtacttgaaaacgtaacgacccatatcgagcgtggctccgatccgaaacaggcagccgtgcacggaacaaatgaggtggcaatctctgtaattgcttctacgttgaccatgattgccgtgttcttcccgttgacgatggtaagcggtatgtccggtgtgcttttcaaacagttgggttggatgatgtgtgccatcatgtttatttctacggtcgccgcactatctttgactccgatgctctgttctcagttacttcgcttgcagaagaaaccatcgaaaatgttcaagctcttctttactccgattgagaaagcgctcgacggacttgatacttggtatgcgaagatgttgaactgggctgtacgtcatcgtccgattgtgattgtgggatgtattgctttcttcgttgtcagtttgctgtgtgcaaagggcatcggtacggagttcttcccggcacaggataatgcccgtattgccgtacagttggaacttccaatcggtacacgaaaagagatagcgcaggaattatctcagaagttaaccaaccaatggctgacgaagtataaagacataatgaaagtctgtaactatacagtcggtcaggctgattctgacaacacttgggcatccatgcaggacaatggctcacatataatctcgttcaacatcagtttggtagacccgggtgatcgtgacatcactttggaagcagtctgtgatgagatgcgtgaagatttgaaagcctatccggaattcagtaaagcacaggtaatcctcggaggtagtaacacgggtatgtccgcgcaggcaagtgccgactttgaggtttacggatacgatatgacagtaaccgatagcgtagcagcccgtctgaaacgtgaattattgaaagtaaaaggcgtgaccgaggtaaatatcagccgtagtgactaccaaccggaataccaggtagacttcgaccgtgaaaaactggcgatgcatggcttgaatctttcaactgctggtaactatctgcgtaaccgtgtcaatggtgcggtagcatctaaatatcgtgaggacggagatgaatatgatatcaaagtgcgttacgcacctgaataccgtacaagcctggagagtctcgaaaatatcctcatttacaatgcacagggacaatccgttcgtgtgaaagacgtcggaaaggtagtcgaacgttttgcacctcctaccatcgaacgtaaagaccgcgaacgtatcgtgaccgtttccgctgtaatctccggagctccgctgggcgacgtagtagctgccggaaataaggtgatagataaaatggatcttccgggagaagtcaccattcagatttccggttcgtacgaagatcagcaggattcattccgcgatttgggaacacttgccatcctgattgttgttctggtatttatcgtgatggcagcgcagttcgagtcactgacttatccgtttatcatcatgttctccctgccgtttgcgtttagtggtgtcttgatggcactattctttacgaacagcacattgagtgtcatgagtttattgggaggtatcatgttgattggtattgtggtgaagaacggtattgtgcttattgactacattaccctttgtcgagaacgtggattggctgttttgaactctgtggtaacagcaggtaagagccgtcttcgtccggtactgatgaccaccgctactaccgttctcggtatgattccgatggctatcggtggcggtcaaggttcggaaatgtggagtccgatggcaattgccgtaatcggtggtttgacgatatctactgttttgacattgattttgattcctactctatattgtgtattcgcgggaactggtatcaagaaccgtcgtcgtaaactccgccgtcaacgtgaattggacgtttatttccaggcgaataaagataacattattaagaaataacagaaaagaaatatgaaatcagtattgataacattcgaccaggcttattacgaacgaatcatggcgttgctcgaccgtttgggttgtcgtggctttacataccttgaaaaagtacagggacgtggttcgaaaacaggcgatccgcatttcggaagccatgcctggccaagtatgtgctcggctatcctgacagtggtagaagataacaaagtcgattcattgctcgacaccttgcataaaatggatttgcagacggaacaattaggtttgcgtgcatttgtgtggaacattgaacggaccatttaaatgtgatccggtagatagataaaaaggaaaggagaatctaataaataatgtagattctcctttctttttgtggcttttgtctatctttgcggtcgtttgggattttagaaacattatggagataataaagaattatttgaaatattcgttgtggttcgtactgattgtatttgcagccttactcgggcttcattggcttccggtactgaccattgacgggcacacgatgaggcgtgtagaccttttgagcgaccttcgttatccggaatcggagattgccacagctgattcggacagtatccctttgcctccagttgtaaagccggtctttgtagatacttgtcgtgcaggtatgacttgcattgaagattacagtgattccaccctccgggggatggctcctttttatgaagcactcaatcgtatctcttccagtgattcagatgactctgatgacaaacaggtacgcattgccgtattcggagactcctttatcgaagcggatatatttacagccgacttgcgcgaaatgcttcagaaacaattcggcggttgtggtgtaggttttgttaccatcacttccatgacaagcggttaccgtcctacggtacggcatacatttggcggatggtccagccatgcagtaacagacagtatctatttcgataagaagaaacaaggcatttccggacactattttgtcccccggaacggagcttatgtagaactacgcggacaaaataaatacgcctccctgctcgatacttgtcaacgtgcttctatcttcttctataataaagattccgttcttctttctgcccgtgtgaacaaaggagaaagcaagaattactctttaggcccttctgatggattacaacaagttcaggtggacggacgcatcggttctatccgttggacagtagatcgtgcggactctgccctgttctatggcttggcaatggatggaaagaaaggaatcattctcgataacttctcgttgcgtggcagttccggtctttccctgcgcggtattccggtacaaacgttgaagcagtttaaccgccagcgtccttacgacctgattatcctcgaatatggattgaatgtagctaccgaacggggacgcaattatgataattaccagaaaggattgattacagctatcgagcatctgaaagaatgtttcccacaagccggaattctgttattgagcgttggcgaccgtgattataagaacgaaaacggcgaactccgtaccatgcccggtgttaagaatctgattcgttatcagcagaacattgctgctgaaagcggtattgcattctggaatatgtttgaagcaatgggcggagaaggcagtatggcaaaactcgtccatgccaaaccctctatggcaaactacgattatacgcatataaacttccgtggcggtaagcatttggctggattgctttatgaaaccatgatctatggtaaggaacaatacgacaggaggcgtgcttatgagaaagagtaacctgctgtccatctttattctcattctcgccggtatgttgagtgtcccttgttttcttacagaaacaatcgcgcaagaccgtatgcctgtatgctctccattgggaaagactgcaaagcggataaagcctttacgggaaatgaactgggcgaatgatacgatcaacgtacaagtagccttccctgctgcttttcgcgaaaccggacggaatgagattattgacagcattgctctgctggctcccgtctttgaacatctccgccaggtacgtgccggactctccgaagatacagtccgcatcgttcatattggcgatagccacgtgcgtggacatatctatccccaaaccaccggtgcccgtttggcagaaacctttggtgccatttcttatattgataaaggcgtcaacggagctacttgcctaacatttacccatccggatcgtattaccgaaatcgctgccttgaaacccgaattgctgattctctctttcggaaccaatgaaagccataaccggcgttataatataaatgtgcactacaatcagatggatgaacttgtgaaactgttgcgcgacagtcttcctaacatccccattcttctgactacccctcccggttcctatgaaagtttccggcaacggaggcgtaggcgcacgtatgccatcaatccccgtacggcaacagcagcggaaactatccgccgttatgccaaagaccatcgcctgctcgtgtgggatatgtatgatgtagtcggagggaagcgtcgtgcctgcaccaactggacggaggcaaacctgatgcgtcccgatcatgtacattatttacctgaaggatacatcctgcaaggaaatttattataccaagcacttatacaagcatataatgactatgtttcccattgatatagatttcagtagactaaaagaggtacttacctacgatccgcaagccccgatgatattcagcagcggtatcttcctttggctgttcgctgctttcatggtagtgtatgtgttgttacaacgtaaatacactgcccgcatcttgtttgtcaccctcttttcttattatttctactacaagagtagcggcacatacttctttctgcttgctatagtcaccgttgccgacttctttcttgcacagctaatggatcgtgcagaagggtattggaaacgtaaaggattagtagttttgagtctgagtatcaatctgggacttcttgtctatttcaaatataccaatttcctgggtggagtgatagcgtcattgatgggaggagagtttaccgcccttgatatattcctgccggtcggtatctctttctttactttccagtcgctaagctacaccatcgacatttaccggagggacataaagccattgacgaatcttttggactatgctttctacgtatctttcttcccccagttggtggcaggacctatcgtgcgtgcccgcgattttatcccgcaaatccggaaacctctctttgtttcgcaggagatgttcggccgcggaatcttcctgatcgtatccggtcttttcaagaaagccattatctccgactatatcagtatcaactttgtagaacgtatttttgataatcctactctctattcgggtgttgagaatctgatgggagtgtatggttatgctttacagatttactgcgacttttccggatatagtgacatggctatcggtatcgctttattgttgggctttcattttaatctcaactttaattctccttataagtctgcctccattaccgaattctggcgtcgttggcacatctctttgtccagttggctgcgggattatctgtatatttctttaggaggaaaccgaaaaggtaagttccggcaatatctgaatcttatcattaccatgtttctgggtggattatggcatggcgcatcttggaacttcgttctttggggaaccttccacggagttgctttagcattgcataaaatgtggatgaccatcaccgggcgtaagaaaggagaacaaagtcatggttggcggcgtgtattcggagtggttattactttccattttgtctgcttctgctggattttcttccgtaatgccgattttcagaactcaatggatatgctgggacagatattcactactttccgtccgcaactgttcccacagttacttgaaggatattggaaagtattcgcattaatgttgctcggcttcctgcttcattttgctcccgatagctgggaaaatgcagcttgccggggagtgatccgtctaccgttcgtaggaaaagcagtgttgatgatagctttgatttaccttgttattcagatgaagagttcggagattcagccgtttatctatttccagttctgatccgccttctttttaatatccggttgaagccgtaattggaatatttttcctttctttgtgaaaggaaaatataaacattctgctttatggaaaactctttcagttatcagccggcagccgatcgttacgaacagatgccttatacatattgtggcaagagtggcttgcagttacctctaatctctttgggattgtggcataatttcggtagtgtggacaatttcaatgtagcaaccgacatgattaagtatgctttcgatcacggtgttactcattttgacttggcaaataattacggtcctgctcccggaagtgccgaagtaaatttcggacgaatcttgaaagagaactttcaaggctaccgggatgaaatgattatctcttccaaggccggtcatgacatgtgggcaggtccttatggcggaaatagctctcgaaaaaatctgatggcgagcattgaccaaagtctctgccggacaggtttggagtattttgatatcttttatagtcatcgttatgacggagtcactccagttgaagaaaccattcagacattgattgatattgtgaagcaaggtaaagcattgtatatcggaatttctaaatatcctcccgaacaagcccgtgttgcctatgagatgatggcaaaagccggtgttccctgtcttatcagccaatatcgatatagtatgttcgatcgtgcggttgaggctgaatcacttcctttagcagcggagtacggttccggcttcatagctttctctcctttggcacaaggattattgaccgataaatatctgaacggcattccggaaggttcccgtgctgcccgttcttcgggttttcttcaacaatctcaagtgacgcatgaaaaggtagaagctgcccgtcaattaaatgaaatagcccgccgccgtgggcaaacgctggctgaaatggctttggcatgggtgctgaaagacgaaagaatgacatcagtgattgtaggtgcaagttctgtgaatcagttagccgacaatttgaaagcgctggaacatttggagttcacggcagacgagttgaaagaaatagagcaaattttacccggataaattcagcctgattcataaggaggtgtcgtatttacaatttgaattcagcagtctccgctgaattcagcttctgcaaatgttttttcatatttatttctcatgttctcataaatgatatgataatagtttgtaaatcaatgatataatactatgagaaatgaactgtgaaatggcatttctcatagtatttccatcatttacccctaaaaaagatgcatttttcataggtttcaaatcatttctcatcttattctcatactccttcttatttgttttgctcatttctcatacatgatggctgcagcttttcccggactctcgccggacttacgattattcctttccttatgttgtttattaatcaacttcctattgtttactgctttcctgtgtatcattcaccttatatcttactgttttcccttactcactgctatttcttcctgctactatctgtatcattgcactcgagtgaacagatcgttccactctagtggacggttctttctactctagtgcacaggcctgtccactggagtggaacgatatagataccggtagaaaaatatgcggatacctgctctatatacttccaataagcactgataatatattgtaaataggtgcatggtctggtattcaacttggtctttagcttaggatctagcttgagaatttataggataaatagtcaaaatactatgagaaataccttgataagttatgagaaataggttgttttatgtacaaaatgcgggtcatactatgagaaataccgttttgtatttttattctcgttgtgttatattgttgatttacagaagattattgtgcatgttatgagaaaatgagaaatgaaaatgagaaattgtttctagtaggatattgggtttgtgttttttatgcgatatagactgaattaattgatctatcatgtttttcctgtcaaaattgtttgtttaatagatatttatttctacttttgtgataacttactttcgagcgaaggaagtagttttttaataattttattgagaacggttatttgttacattcatatataaaatccgctaaattttaactttcgtgaatggaatgaatgacaggtctcacgcactattgtctgtataaccttgttatatatccaattgggcgtggggctatcattcatgttcacggaaggggtcttagcggatacctatatatggcatgaatagatagtttccacgctctctttttttataaccctcgcaccaccgggaactgatgcggtaataaacgcaacctatgtacggagactttaatcgaattgttgttcagctgactcagcatcctgttatgtacaaacccctctcggatttaacctatacggaatgtgaactagcctatgctttgatacgggagttgattgatttgtcaatcgaaggggattatactttattggactatatccaaatggcccggctggaatactatctgggtgaactgtcttgtaagataagctgtagtagggaggagactgcccttcattatgcgggcgcccttcatctgttagaaaaaggcggctttgatttgggcataaagaagtgggttgaacttgtcagcctgcgaatagagaactctaaaaaagaatgacattctgattttatagttagaatctgattagtacccactctgtatttatccgatctatacctatggaatagtcaaccgttagaccgcttagaaaaagtattctgacggttgattctaaatcctcttgcttttttctaatatctattttcttgtagttttctttttcgtctttttcttttcattctcttttcacgccttcacgcgcccgcgtgtgatataataatgtgtatccctcttattgtttccgcacacaatttgctattattgaaacttagtgtttaataatatattattaatgtaatttttaagtagttatgaaaagaaaatttgtaaaagtgatgttcttcggggcgttggcacttgcagttagcacagcagtgacaagttgcaaggactacgatgatgatgttaaaaatttgcaggagcaaattgataagattacatctacaagtccggtcagctcggaagaattgaaagcggctgttgataaagctaaaagtgaattgacagaactgttgaacaagaaagctgatgttacagctttggaaaaagaaattcaagaattgaaagatgccttagctaaagggggagatgaagctttattggcagatcttgcaaaacagttggcagacaagactaatttgttaacatgggaaaatcttaagactgatgaaaccattgctaaattaaaaacggatattgatgctttaaataaagtatcatcaactttggatgctttggtaaaagcagagcaaaaatataaagaatcaggtgatttaagtggatttgacaacacaagcttcgatgcattaatcaataatagcattaaagaggcaatagagaaagagggtgatattgctgcatatgttcaaggtgtagtacagaaagctactttagctgattttaaagctatcaataatgaagtttctactttgacaggtggtgtttggaaatccatggaagcatttattacagattgctatactcttttatatgataaagaagatggtattctggctagattgacagaactggaaaagttgcaagaagccgtaaatgccttcattaaagaaaatgataattacgagaagtatgctgatattctagaccaaattgaagcatccagacaggctttgaccgcattgagtcttcctgaaggtagtacaaatcttacagaagcaattgaagctataataagagagcaattaaaagaagaagattcgtcacttgctaatttgaagaaagaacttcaagatgagatcaatgctatcaagaagatggtgcaaagcgtatcatttgttcctaagacatctgatagaattgtaagctttactacattatatgcaaaagcaaaagctacagacgccaattatggaaaaataactctcgatggtgcttctactcaagaagtcatgttccgtatttctcctgctgatgctgctgaatcatttgttgataattatgatgtgactttcagtgcagacagagaaatgacgagagcagtgcaggtagatcagtttgtgatagttggtgaaccggttatagatggtggtttagtaacttatacaattaagtctaatgcaacaaagagctttgctgtatgtatgcacgtagttactaaagaagataaagtaggaacattaggtaaaacagatattacttctgactattttgctgctattgtaggtaagaaatatttggtagatgcatattataaagtagatgctgatgtagatttggaaattccttacgatgttaaagatggcaaggcagaatataacggtaaaggtcgtgttgtattatctgtatctaatagtgcagatggaactactccgtcagaggttgaattgtctgaatatccaggctttgatccaaaatctttgactacaacatttagtgtagttaatgacacttacttcaaggttagtggtactgctgtaatgctgaatgcctatgagactccaagttatattggccaagttacagatgttaatgcgaaagtgactgctgcaggcttctatactcctgctgctgataagaagattggtacagtgactgttactaagacaactaaaaaagctactattgattatggtaagattgaacctgcaacttggagtaatgacgcacaaactgttgcagcttcgaaattcccattgaataagatttatgatgctgaagacgtgaagttgactcttactgaattccaagctttgacaggtgaagtagtgaaagaagtaactgataaggtttattttgctatttctacagatccttcttctaaaaatgaattaacagctgtcattgcagcacaaactcctgccggtgtttatcctattaaggctaaatttacttctgatggtagagaaattatagttactgctactattacagtacaaaaccctgaaattgcagagttagcagtagataaatatctttggggtggaacagcaacagctggtaaagttggatttactccaacactggatcaggaagaaaaaccatcttctattactttgagctatgatttatccaagctgtttactaactattctgctgtgcaggcagctgttactggtgttacaggtgctactttgaaaattgatgttcctaattggaataagattgaaggtattggctatagtgaaccgacattgacatttaggaaggatgactatacaggtaagactacagacggaaaagatgcgaaagtacaaatcgttgctacagtgtctttagcgggtacgactacacctcttcagaaattaacagctgatgtaaatatcaatgatattagtggttcttgggttgctggtaagaaagcagtagaactgaacagcaaggctggtgtttatcctttggccgatggatttagttggaatgatatgagaggtaaagctatgtggaaagatggtagtcaggtagatgaccaagttgagtttggcacagctactccactcgctatttatggtttgactgctccttcattcaaatttgtagatgctgaaggcaaagatacaacttgtccatacttaacagttggtaatgatggtaagttgtcatttacaactactggtaaaggatataattttcaaactgattataccgcttacgtaatgattgttgctagctcacaatggggtacaattactaattatgcaaataataatgtaataacagtaactatacctgctaatgtgaagtaaaacagataaaacccttcttcaccttgtgtgaagaatacgccgagaagaaacagagtgaaggatttggcttgtgaaagtcaatccttccaattctgttcttcttatagaaagggatacctcccttatttcccacaggtatcccttttttttatttcataacatctccttatttgcactagaaaccaatttgctagtcccttatttccctatagattaaggagatgttttgagaatatagaaagcccgggcttgcgaaagtacgggctttttcattattatttatttatcggattgaatataatggaagttctcgtcatacagtcctacgagcaggctttggcctttaccatccactttcagcccgccatatacggctttttgataaagagtatcttgtccctcttcaaagaagaaagactcggcaccgaggaagatccggtgacgtactattttatatttgatgactagctcattgtcgtttacaggctctaaagcgttttgcagccgcactatttttcctacttgattactgtcaatttgaagtatggcataaccgcgtatggcagtttgttggtctagcagatctgatgaagcttctttgtagctaagcctcatatagtctccttgcataagagagcggggatcgacgggagctagctgtaacaaaatcaactgtccgtctttcaaagtttgctcttttttataaaccgaccagttgaaatatcccagtagcagtatcaggtttgcaataatcaatattcggctatactttttcatgtcttgttcttttttgagtgaagaaataccaggctgtaatacatgcaattccgatgaagaaaagtgtcatggatttggtgagcaggcttaaattcagatcataatagtatttggaaacggcatagataaaaagaagaagcgaggcagcacactccgctttgtagccataatggaaacatattagaatcagcaacaaactgccggataaataaggagcaaacacggtaggcagacagataacaatacaaagaatatagataccaatctggttcaccggatgatccactttcatgacctgcatgattcgttgaaccattataagaataccgatccatatacaaacagacagtatgcaggatacaagccagctatttgtttctgatatcagataattgattgataatcctcccagtgagacgataccggatatgaataatccgaaatgaaatggtttgtatttggaaaagtaattctctgttcctatacattcaaacaacttagtttcaaagatgttggcaaataaaaatagtgcaaggataggaactacagctatttgcaagggataaaacgaagaaaagacatgggcggcttctccgaagaaagatatattaaacagaatgactgaaagaaaggggaggataaaccctcttgataacaagaatgtgagaatactgattcccataagtgtggtgaagaggatattaatgctggcatttataccaaaaccaatcaatacacacccggctatgtataaagtgatgttcattgcatccagaaaagaccggatcactatgcggctgattgttagggtagtgagaattaatatacttcctacaatcaggcaagaaatatcggagcggaggattctggcaagtgccagaaatcccagaaagaaaatagccgtcaggattcctccgataatagatacggcttgaatggtgaggctatgcttctgtgtcataccattgcttttttagatgaagaatgatgtaaatgagtaaagttgttccggtgatgacaataacccctccgtagaagaatatctgaacatccctaagaccgctttgtgatatgaatgtagtcaatagaatcattaacgcagcaaacggaatgatagccagatagaacaggctttttactttccatccataccaaagtcccgcagagaataaaaggagggtgcttatgagaggaacagacaatatggcattctcttcgcagattgccatcattaacagaaaactggtatgtataatagtagccagtgaaagaagactgacaaaccagcgattgttgctgtccaaatgaccttttacactcatccattccgtgatgatcgttgttaaggcacatatccaggttactgcattggccagcaaagtcatttcccaggagttggcactggcaatctgtatattgtacaaccatatcgtagtacaaagtaatccgatgaacgtcagccataacggagcgaaacggatagcaaccgcccagagaatagtgaagagagtccatcccaggaaaagatcgtaagcatcggctcccgtttggtagatttgtccgaagacagcgaaaagcgtgcctatcaggaatgtagctccggtcaggagaatttgtttgacgagcttattccaatgcgtgaatgtagcgagcaggacagaagctactaataacacttctactattcctaactttgcaaatttgggtaattcctcccagttgtaggcaaagaagaagataattcctgccactgtaaaaccaacgcccactgccaataaaaaaatagaaaggaattgattccattgctttttatctgcgtacagcgcttgtcgggataaaggcgaagagtcggtcttttccatgtgtttttgctttttgatgattacaaacataagaaaataaaatgattatcacctcaagatagactataaaaaggtatgacttaccttattgaaattgacaataatagtaggtcataccttgagagaggttatgaaaatattcaaaatagaataacttaaaatacctcccgtatatgcttaaagttagaattgatcgtatcaattacttcttgtgaacgaccgttgattaacaacttatacattgattgtgcaaagcccaccatttgaccgaattcaattttgggaggcatggccagtgcgttcggatcagtcatgatattaacaagtaccggaccgtccaactcaaatgcattcagtaaggtagtcaacacttcttccggatcactgacattaaatccggtcattcccattgcttccgccacttgagcaaagtctggattcaacatatttgtctgccagtccggcaatccgtccacttccatttccaacttcaccattcccaatgaacggttgttgaatacgataattttaattggtaacttatattgtacaacggtttccaagtctcctaaagtcatagacaagccaccatctccgcaaagcgccactacctggcgatccggataagctagtgcggcaccgatggcttgcggcaaagcatttgccatagaaccatgattgaaagaacccagcatgtggcgtttgcctgtcgcttgcagataacgtgctccccacacacaagtcattcccgtatctactgtgaacacagcatcgtccgaacttagtttgtctatttcggacatcacatattcgggatgaatcttatttacatcgcctttatcttccgtgtaagcagccagatccttctttacgccttcatatcttttgagttgtttcaacaggaacgaatcatctgtcttcggattcagcatacgcaatagactttggatgctcagtttaacatcaccgcaaagtccgatatccacctttgcacgacgtcccagacgttcgggctttatatcaatctgtgctatcttgatgtcatccggcaggaaagcggaataaggaaagtcggtgccgagcatgagaagcacttcggcttcatgcatactgtaatagcccgacggcattcccaacaatccggtcatacccacttcatacggattttcatattgcacctccatctttcctttgaaagtatataccaccggagcattcagcttctcggaaagagcaatcacttcctcgtgagctccccggcaaccgatgccgcagaaaagagtgatacgcgtatgtttgtttaacatgtcagctaattgagccagatcttcttccgacggacaaacttccggtggggcaggatagttgataaccgacgagtcgacagcaacggcagaagcctttgccaagtcacccggaagcccgataacggacacccctttgcgggtgacagccgtttgtatggccgactggagcatacgtggaaattgtgtgggagtagtggctacttcattataataactgcaatcgttaaaaagtttgatggtattcgtctcctgaaaatattccgtaccgaactctccggtgggaattgtagaggcgatggcgattaccggtgcgccggaccggtgtgcgtcatacaagccgttaatcagatgaacatgtcccggcccgctacttcccgcgcagcatcccgggcgaccggtcagttgtgcttctgccgcagcggcatacgcccctgtttcttcgtggcgcacatgtatccattttatttgatcgttttttctgactgcttcgtttacttcattcagactgtcgcctgttacggcgtagatgcgttcaactccggattttaccagagtatctatcaactgttctgctattttttttgccatagctgtaattggtttaggattgatttttatgtaataacagatggctgcaaagaaaagttctgatttaacatatgctaataacgcctttgtgtcgggacacatcaccacttttatgttaaaattaattctgtaacaactttttagtaaagatgtataaacaattgcaatatccttttgttatctttataggcgaaatcttaacctaatgtattaaacctcttaattactctagaaaaatgaacagaaatgaaatcggtgtgaatgccggtaaggtttggcaactgcttagtaataatgagaagtggagctatggacttttgaagagaaaatccgggctgaaagataaagagctgggtgccgctttggggtggttgtcaagagagagcaaaatagagttcgatcagtgcgatgaagagctttatgtatatctctgtgtgaatgtttatattggctgaaagagtttgacgctttaacgagaacagaagaatctccggaggaatgacagcatagtcagcacttcggagattcttgtttttttatcctttttctgctttatgtttcttcctttcaatggatttccggaaataattctgttactttgcatcacgaattaaaatgtaagaaacaatgagaagttttgcctccgacaataattccggtgtgcatccgttggtaatggaagcattgaaccgggctaatatagaccattctttaggatatggcgatgataaatggacagaagaagccgtagcgaagataaaggaaaccttcaccccgaactgtgtccctttgtttgtattcaacggaacaggcagcaacgtggtagcattgcagctgatgacccgtccgtatcattccatcttttgtgcggaaacggctcatatctatgtagatgaatgcggctctcctgtgaaaatgacaggttgtcagatttgtccgattgctactcccgacggtaagcttaccccggaattgatgcaaccctatctgcatggtttcggcgatcagcaccattcgcaacccagagctctctatatttcccaatgtaccgaacttggcaccatctatactcccgaagagttaaaacgtctgactgactttgcccatctgaatggtatgtatgtacacatggacggagccagaatagccaatgcctgtgccgctttgaatctttccttaaaggaactgacagtagactgcggagtcgatattcttagttttggcggaacgaagaacggactgatgatgggagagtgcgtgattgtatttaataaagacctgcaaccggaagcccgcttcatccgtaagcaatccgcccagctcgcttcgaagatgcgttacctctcttgccagtttacggcatacctcacagataacctctggctgaagaatgccaaccatgccaatgcaatggctgccaaactttacactgaattgaagaaactgcccgaagtaactttcactcaaaaagccgaaagtaaccagttattcctcaccatgccccgcccggttatcgaccggatgctagagtcttacttcttttatttttggaacgaagagaagaatgaaatccgtctggtgacttcttttgataccacagaggaggatgtagacgagtttataagacttttaaaacgttaaaaaggaaatccggaacaacaaaagcgcctgaatatctgtttttataggaagtttgaaactaactttgtccgcaaagttttctacttcttatgattatgaatactagacagaacaggctaatcatattcgcgcttttgttgttgacacaaaccccgttgggcgcacagctgcattctactaaaattgaactgccggaggattctatatctgcaaccatggaagattccattccggcaaagcgcagtttctttaaaaagtttcttgattacttcaatgacgccaataaggaaaaaaagaataaaaagtttgatttcagtgtgataggcggcccacattattccagtgacaccaagttcggactcggactggtggcagccggactatatcgaaccgatcggattgatacgcttcttcctccctccaatgtctctctttacggagatgtgtcgactgtcggcttctatctgttgggagtccgcggaaatcatctgtttccaaaagataaataccgcttgaattacaatctctatttctattcttttcccagtctgtattggggacggggatatgacaatggagcgaactctgataacgaaagcgattataaacgttttcaggcacaggtgaaagtcgattttatgtttcggctggcaaagaacttctacatcggcccgatggccgtattcgattatatcgacggacggaactttgagaaaccggaactatgggaaggaatggccgcgcgaaccactaataccagtctgggactttccctcctttacgattcacgtgatttcctgacaaatgcatatcatggctattatttgcggatagaccagcggttcagtccggcttttctcggcaataaatatgcgtttagcagtacagaactgactaccagttattatcagccggtatggaaaggtggagtgctggcagggcaattccacacattgcttacctatggcgataccccttggggattgatggcaacgttgggaagttcttactccatgcgcggatattacgaaggacgctatcgggacaagggagcaatggacgcgcaaatagaactccggcaacacgtctggaaacggaatggagtagctgtatgggtaggagcgggaacgatttttccacgactttccgagttcaccccgaaacacattctgcctaattatggcttcgggtatcgttgggaatttaagaagagagtaaatgtacgtttggatttagggtttggcaaacaccagaccggatttatttttaacatcaatgaagctttttaaaaatataaagaattggttggaaaatcaggaacatctgttttatctgttcctgtttatcttgatagtacctaatatggtactctgttttacagaacctttaccatttatggcaaaagtcgccaatgtgttgttacctttcggttgctattacctgttgatgactttgtcgaggaattgcggcaagatgctgtggattttattcctgttcctgttcttcggagcctttcagatcgtgttgctttatttattcggccagtccattatcgctgtcgatatgtttttgaatctggtcaccaccaattcgagtgaggcattggaactgctcgataatctcacacctgccattattgctgtaatcatactctatgtacctgccctgatattagggatgatttcaattatacgtaaacggaaacttacggtagagttcattcgcagggaacggaagagagccttcctggtctttggaatctccctccttagtcttgtcggagcctatgtgcaggattcgggatatgagttgaaatctgatttatacccgctaaacgtatgctacaacgtaggtcttgcctttcaaagaacagctctgacacaggattaccaccgtacatccaaagactttactttccatgcccggcctactcatccggagggaaaacgggaagtatatgtaatggtcataggagaaacctctcgtgccctaaactggcaattgtatggttacgaacgtgaaacgaacccgctcttatcccggcaaacgggtctgattgctttcccaaaagtgttgacagagtcgaatacgacacataaaagtgtccccatgctgatgtcggatgctactgcctgcaactacgactctatctaccatcaaaaaggaatcatcaccgctttcaaagaggcaggattccggacggcttttttctccaaccaacgttacaaccattcatttatcgacttcttcggaatggaagccgatacgtatgattttataaaagaagattcggtcagttctacctataatccttctgacgacgaacttctgaaattggtggaggaggaactggcgaaaggtgcaacgaaacaattcatcgtacttcacacctacggttcccactttaactatcgcgaacgttacccgtcggaagatgctttctttacgcccgattatccgatggaagcagagagaaaataccgggataacctggtgaatgcctatgacaactctattcgttacacggatgattttctgtcacgacttatccgtatgttggaaaaacagcaggtagatgccgccatgctctacacttccgatcatggagaggacattttcgacgattcccgtcatctgttcctccacgcttctcccgtaccttcttattatcagcttcatgtgccattcctgatttggatgtccgatgactaccgcgaaacgtatcccgaacgttggaataccgctattgaaaataaggataagaatgtttcttccagcagctctttcttcccgaccatgctgtctttaggcggaatagaaactccttaccgggatgattcgcaggctgtgacggctttgcactacgtcctgaaaccgagggtttatctgaacgatcacaatgatccccgtccgttggatgatttgagcatgaagaagcaagacttccagatgctggaaaagaggaatatcaagtattaagtattaggtattaatccttgttaatttttgcatccaaaaatgggattggcgtgttatttgccgtatgatgtatgaacgattaaattcataaaacatggcctatatagattattacaagattcttggagtagacaaaagtgcttctcaggatgatatcaaaaaggcttttcgtaagttggcccggaaatatcaccctgatttgaatcctaatgaccctagtgcaaaggataaatttcaggaaatcaacgaagccaatgaagtactgagtgaccccgagaaacgtaaaaagtatgatgagtacggagaacattggaagcatgccgatgaattcgaagcgcagaaacgtgcacagcaacaagccggaggctttggcggtgcaggaggttttggcggattcggcggtgcgggtcagggtttctccgacggtaacggaacctattggtatagttccgatggagaaggattttccggtggcaacgctagtggattttccgatttcttcgaatcaatgttcggacatcggggaggaagaggacaaggttctgcgggattccgcggacaggactttaatgccgaacttcatctttcccttcgtgatgctgctcaaacgcataagcagatattgactgtaaatggtaaacaggtacgtatcactatccctgccggtgtagccgacggacaggttattaaactgaaaggctacggagccgaaggtgtcaacggaggacctgcgggcgacttgtacattacgttcgttatagccgaagacccggtgttcaaacgcctgggcgacgatctgtacgtagatgtggaggtagatctttactctgccgtattgggaggcgagaaagtagtcgacacgctggacggtaaagtgaaactgaagataaaaccggaaacgcagaacggtacgaaagtccgtctgaaaggtaaaggattcccggtttataagaaggaaggacaattcggtgacttgattgtgacctattctgtcaagattcctacgaacttgaccgacaaacagaaagagttgttccgtcaattacagagtatgaactaaaatgaatgagtactatgcagaccgaattaataattgtcagtgaatactgtcacaaatgtcatattgagccttcattcatcgaaatgttggaagagggcggtttgattaacgtgcataccgaaggcggtgaacattatctgcttttgtcggaactcccgaacgtggaacgttatagcagaatgtactatgacttatccatcaacatggaaggtattgatgccattcatcatttgctggaaaggatggaagatatgaggcacgaaatgcgttcgcttcgcaaacaacttttgctgtaccgggaacgggaaatagaagatatggactggtaaaaaatagagcctctgtttgattcgaacagaggctctatttatagtaaacggaggctctgattcattcaatcagagcctccgttttttcaggatgtttatgccgttattttataatacaatatacgtgcaaatctcttccagatagcgtgcgtcgatagtgtcgaagctatccaatgtatcactgtcgatatccagcaccccgacaactttcccctgcttgaggattggtactactatttccgatttcgagtccgaactacaggctatgtgtccgggaaactgctctacatcaggaacaatcagtgtacgggcttctttccaagcggttccgcaaactcctctgccaaagcggatgcgagtgcaggcaatggggccttgaaacggacccagtacgagttcttcctctttcacaaggtaaaagcctacccagaagaaaccgaaagtctgctttaaggctgctgccatgttggcaagattggcaatgagatctgcttccgtacttaccaaagcatgcagttgcggaagtaactcccgatacttttcttccttgcttcctgtgtggatgattaaattttctgccatctctttactatttgatttggttcaggatgctcggatcttttatcttatcgtcttctgcaaagaagataatcttagtcagtatctcggcagtcttcggatcttcatctacgaaaggcaggaacaggcgtccgcgattttgcgaatgtaccggaagaacggctatctgtgcaccaccttcctgatggatcacaccgctgcccagatggatattatacttacccagtttgccttcaatgtgagcaaaacttccttttatcgtcacgttcttgaaatggaacaacggcattgtcagttccaccagcacgctgcgtatctcgatggtagagtggctggtttccggatcgacgcttccggcatgagctacacttactgccaagtctacgtccctcatcacttccgagaagatgacaggaggaatctccgagattttcatcagcttgtagtccttgcggttgtggaagcagacatattctaatgtcggagcttcgatgtcggcaggagagaaccagtctgccatcgcatagatggtggcgatgatgttctctttgtaatagatcttttggagaccgtcttcatagtcggctacccagcgacggcctttcagtacggcaaccgttttctgcggttggatctggttgccggcatagcggcgggattgagtggcttctatttcttccggagtcggaacgtaaagttcgcggaatacctgtttgaaaggttggcggattgatttatcgaacaggaatttttgataagcatgccagtctccgcttgtatacaggtctgtggggtgcgcgatgcgtaactcgtctttcggttttaacgggaggcaaacggcattcactgtaatcagcaatccatcggtgtagaagcccgtctgtccgttgcagatgaagacgagatgtttcagtaatggccagataacaggattctgcatcagcttgcgcaattcgttttcttcaaaatgggtgcagtcttccatcgcctgttccagcatgatgcgcgaacgggtgtactggtctttcagctttttgtgtactgctttcagttcttctatatacggatgctttttcagcttggcaggcatgctgttgagctctttgccgtctttgatttgcttaatctccgatttaccttcctcgttgatttgtacatacacttctacgccgtctatctctttgggggacaggtagggaagaagttctttaatcagttcagtttccatgctccaggtcaggcgggtaacgtctccgtaaccggagttgcgtgccaggttttgcagagcgatgtttaccgctttcttttcgctttcctgtctttgagcaccgaattccttgctctctttcaggaacttttgcaggtattgataacgatccagcagttctttatccggcttccgtcccaatgggatgaggccgtagctcatcaataagtctttgttgcgcttggctattatttctttctttatatctgccgccttcactgcaccgttggtagcatcggcaaacttacgggcacgggtatggctgttgctgcatgaaatatatttggcggcattgtagaccacttcgaagcgttgcttgccaattgtcttaaatgcatctttgaaccagtcgatgtcaaaagcaccttcccgcaggtcatctacgtcgatgggggtgtagcgggcgataatcgctttcttcttgtcgtcacacgtttcattggtgtgggcgtggaaataataggctgcacttgtcagtcctttccagcctattgccttttcagtcagttcaatccattgtggggcgaacatggcggcttctaccagtcgctcgtcgctgatttcggcttgtttcgccagtttcttcagattctcgctggtgtccgtaggcaggggatggcaagcatggagcagactgctcaatacaccccgtttggtgctgccccagttgtaactgtcacgtatgaaagtatctttgccaaatgcttgcagaatacggataaatgtttcggctccatagacgtagcttagttcttctgcaagggaggtgacttgtgtctcggagtctccacgttttaattcaatttcaagaatccggtctaccaccttttgggcgagggaacggaagagggagaagtcgatgtttttgatatcggcgtatctttctttttccttgttgaaacgaacgttgtcgttcaataccatggtgattgctttgatctggctgggagagctgatgcgtcccatcatttcacggtatacttcctctgtcgggatgattcccagcatccaggcacgggcgaagtctgtggcatgaagataagagtctgtttcctctagttcgggggtgtgctccatgtagttggtgagcttataaagctgatagcgcactgtgaagtaacggataaatagatcatcattcatgggcttttgaggcatttcgagccagaagttcacgaatttgttgttatgtatcggataaacgacctgtttttctccgtattccagtttgtcccgaagccatgcatgcttactggtgtactggcggaagatgtttttggtatttagcaaaggcaatagttggagcagcatattgacggccagtcgttgatagacggcttcatctttgtattcgtatgccagtgcttcgatgatgtcactcatctgttcatagtacggcatcttgcggaggtctttctgcaatccgcggtaagtgatgccggcatacatccggttgacaagcggctcaaaagtattacttgatttctggtctgccttgatgtcttcttcatcttcctcgtcggagtcgtcttcgtctttagcggtacctgtcgatgcaagcatgaaactcatcatcagcaatttgtcgtagcttcctatttcttcttcgtagaaggctttccacaattccgggaatccgagtccgctcaatcctccgtagttgctccagtttatcaggacactgttacctaccagacgtgcttctccgtaaccatttttgaattcttcattcttgtaggtttcgatgtatttgcttagttttttgaaaacgagtttggcccttccaaagcagatgaattcgaatgcttttttaacgttgaatcctttgtcctgggtaatttccggcagactgacttcaagagacggatcgtacagaccgaaaccgttatctttggtataatgttgtgtgacgctctcttctgttccatcgccaatcagagattctatcaatactttttctttcgggttcggcttctgaatctctttaactgtcgggatcaattcctgatagatatcttgcaggaattctacattgtgtatggtcttcatcatgtccaatcctgccaggcggcgttcggcaaccttgtctgttagcaagcggcggatgctgccggctagctgttctttgggctgtttcatcagcagattgatagcatggatacgcatttcgctgtatttgaagcgcagtaactcttctactttctggttttgttcgggcgataaggtcatctcggacaatgctttatatgcttcttcacgcacatcttgcgaacggtcgcccagtgattgcagtacatattcttcctgtagcggactggtcggtggagctaatacaacaccgatatagcctgcccgcatataagtatccagagagggcagatagctgcaaagatcgtctttcaatgcagaattattagtcatccaggtgatatatgccattttgagaacgatttccgaacgggtgagttctgtgctttcccaagggaatacataaggagaataaatctctttggcagagatggactgatagatttgcttcagatattcataatggcggaccgcctcttctttgctatcaaaatagtcgtggagtgacggggcgtctttgtgccctccgtaccggctaagatagagaccggacagatacaacggtaagatagccgccaccaccgacggttccttataccatctttcaaaggcatttttactgatgcggtggttcatgccggagtattgcgtacagcgtaagaaataaagtaatgtctgtacctggtatttagcacctttcttgataatttccggcacaagtgtctgaatctcctctgtattatagaatccgatgctccataaagccagatagagttcgactgtatctttgctttgaagagcactgtgtgcttgtttccggtcgttcagaaaacgatggatcagttctacatatttattggtgatacgttcgctgctgtcttgttctccgatacccgtactaactgcaataccgcgtttcacggaagcaaatcgttgcaggtcgttatcgcagatgaccgagaaaagatggagataactttcgggacaaccttcgtccatcgtttccacgatagcttggcggagaccctcctgtaacttggctgccagaagtaacttcccttccagttccagcaaggggcggtatccacttactgcgatagcctggagatgtccctggttgaggcggttggcgttattctcactggtcagcacattgttgaggtattcaatgacagtctggttgccttctgctatttgggcggccatccagttttggcagttcatcgaatccttgtatgcttctatttcttccggagtgtttcctccgttcagtatggcttgatccgtaaatccggtggcgcgcagtttcagaaactgggtcagtgcatctataacgtggccgatatgcagaagaggatttgctgaccgttgtgaccggcgcgagtatccgtgagtgtacggacaccgtgctttgagcttcagataggtgtggaacaggtgggcgtactcgtctcccaatagatagcggagtagcttgttcaacttaccatcgaaaagattggcaacgcttttaatcttctcttcttggataatatagatgatgcaaggctctaatttatcgctgtatgcaccataccgggtatccatgttgaagtattgcataaatacatccaacagtgccattgtctctttgtctaaactggttctctttttcgttaacctttccaggtacggagcaatccgtttatttaatgcgtcattataaatcagtctcatgattcttttcgttttaaatgtgttttataggataatgattaccataatcttcccgacagcatagcgagccggatgaaggttaaggtagattcttctttaagttgaatgggagaggataggtctccggcttccgtatcatccatgaagatacggaaaattccgtcctcataggattgcaaagcattggtgatggcttcgacttctgcggcaggtttgccattatagtttactgcaaaccctactttgccggaagctgttttattttccacttcttcctgtgtgaggtatttcagcacttcgctctgttgcaagcgttcattgtattcgcagacttgccaactgacgatggcttcgatcaacccctgtacattgacaggcggaacaggaaaatcgataggaatcttttcgatactgcactttcgctttcctaactgtttgatttggatatatgctctcatattctctttattgggtgatctggatacttgatgtaatggcattcagatcggtttcagcttcttcgtcatagacaagcatgacaatagcaaaagatcgtttcttgctctcttgaaagtaatgcaacgctatttgttttacatcctctcccggttcatcaggagccccgatgtgcaggggattcgtgatctttgtcatggggagtccgttgatgttgacattgcttagttggtaatcttctgacggttccccttgtgcatttcttgggagagtgagtgataactctttcatgtgttcaaactccttctgcgtgtcgtaggtgagggcggtaatcgttaattgattccctccgttgaccagcatgagtaatggaggttccgcaccatcaataattccttttgctcctgctatttttatccagttggtaggatactggcaactgaatttggtggctgcatcataataagatagccacgtatcgtcattgccgacaggcgtatatgccggaactttcctactggaaagattgtccgtagcattcacagcggaatgattactgttctcgttttcctcttccagttcaccattcagataggcttccacaatgccgctttcccattcattgcgtatctccgggtaaagaggaggaacgtttttgcacaggatcatgaagctgaacaggaatatacagaatataccaagctccccgatgatggagacagtccgctgtgcatcgggtttctcgaacttgtagccgaccacgtatataattcccagaacaaacccgcttaacaacccgccaatatgggcggcattatcaatgccggctttcatcccgtaaaccagattataccccacaaaaatgaggatgctggttaacaatgcctttcgttgttctttggcgatgcgatgaaagaggaggaatgcaaggaatataccgtaaagtccgaagatagatccggaagctccggcgctgattgtctcaccgtgcatatacaggctgaatgcagccgaacataatccggttagcaggtatgaaacgaacatacggcgtcctcctatcagttcttccaacagaagtcctacatacatgaaagcatacatgttcatcaggagatggaaagctccgatatgtatgaagttgcaagtcactgtgcgccaccagtcaccggtcagagtcagcggtccgaagtcggctccccatttcagtagtgacagagtggaaggagacataatacccactccggaagcaatcattacaatgaatacaagaatattgatgtctatcaggatgggagttgctataaatcctttgcggggaatgaagaaagacaggaaagagttcctcttcttttcttcctctatgtaggctttttcttcttctgtgagcgggcggttgaactcttcttcgaaatctttggccctttgggctagttcttccggagtgagtgaggcttttatttcttccattgtttcccgtaacttctggatattttttctgttctttccataatcaacaaattgtacggaagaagactgactgcgaacggatacttccccgtcacttcccttttctatggtaaaggttattgcctctccatgggagtgtatactgaacgggacttcaaaccggattccttccggagttacttcctcgatattccactcaagtttttgagaggcttcgagagccaatataaggatttccgtgtttgataaacctggcaaatacagtttgtcattatatgaaggtttgagtgccatatttctatctctatctacattcatcaattaaaaaattacttatctcactgacaaatgtatagaataataatggaaaataatagaatatgacaaataaaaaaagcatccatttcgtaagaaaggatgcttttatcagatttagtcgattatttgttactttttgtagaacgccaaatcttctttgtcgaagttttcgatgaaatttgtatgcttttctacttccgcttctgcatagttcaaatatacgtgtgcagatttggagaacagttcagaagacttgctggcatcttgaatcagtaagtgacacatgataatatcagcagccatttccaccagtttgcgagcggtgaagtcaagcaattcctgatcctgtacttctttcacagcgttggtacttgcttcaaatttgtcagccatcttcttcaggcgagacatcagcggttccatttccggtgaacaaggaatggcctcaaactcgcggatagtagcgatgtaagaaccattagtcacgtaacggatagcggctacagtctgcaactgggtagttccttcgtagatgctggtgatacgtgcgtcgcgatagatgcgttggcaagcatattccatcatgaatcctgaaccaccgtgaatctggatacagtcataagcgttctggttagcatattcagagttcatacccttagccagcggagtaaagctgtctgctagtttggcgtattttttctgttcctgacgttcttccggagtcagtttacgttcgcgggaaatatcatccaatgctttgtaaatgtctacgtagcgagctgtttgatacagcaaagcacgtccggcatccaacttacctttcatgatagccagcatatcgtatactgccgggaattcgatgattgctttaccgaattgcttacggtctttagcataagccaatccctcattgtaagcagcttggctcaatcctacggactgcgcagcaatacccagacgggcaccgttcattaaagccataacgtatttaatcaaaccgagtttgcggtcaccgcaaagttcagctttagcattcttgtacaccagttcgcaagtaggagaaccgtggataccgagtttgttttcgatacgacgtacgttcacaccaccctcattcttgtcatagatgaacatagaaagaccacgaccgtctcttgtaccttcttccgaacgagccaataccaagtgaagattagcatcaccgtttgtaataaaacgttttacaccgttcagcaaccagcaaccgtctttttcgctataagttgctttcagcataactgcctgtaagtcggaacctgcatccggttcggtcaagtccatagacatcgtttcaccttggcatacgcgaggaatgaaacggctgtgttggtcagcgttaccgaattcgtacagtgtttcaatacagtcctgcaaagaccagatatttccgaaaccggcgtcggcagcagccacgatttctgcacacatggtgtacggagtgatcgggaagttcaaaccgccgaatctgcgtggcatggtcataccgttcaggccggctttcaccatagcgtccaggttctgtttggttccggaagcatattctacgcgaccgttagcacagtgaggaccttcttcgtctacaccttctgcgttagcagcaatgatttctcctgtgatttctcctgtaatctccaatactttgtcgtaagagtctacagcatcttcgaagtccagcggagcgtagtcgaattcatctttatctctgtaattgcgttctttgagttcgcaaatacgtttcatcatcggattgttcaagtgaaacttgagttccggtatgtctgtataataattagccatctttccttacttgctattttgtttataatacttaatcatcttcggcacaacttcttcgatacttccgttgattacgtaatcggcaatcgtattgatcggagcatccggatcgttgttaatggagatgatgataccactttcctgcataccggcgatatgctgaatctgtccggagataccgcaagcgatgtagagttttggacgaaccgtaacaccagtctgaccgatctgacgatcatggtctgcgaaaccagcgtcaacagcagcacggctggcacctacttctgcgtgaagttctttagcgaggtcgaacaataggttgaagttttctttcgaacctacaccgtaaccaccggctatgatgatcggagaacctttcaggttgttctttgccttttctacatggcgttcgatgactttcactacatagtccgtgtcggctacatactttttcacgtcgtgacggattacttctccctgataagtcggagagaggatttctttcttcatcacaccttcgcgaacggttgccatctgcgggcggtgttccgggttcacaatcgtagcaacgatgttaccaccgaatgccggacggatttgatataacaggttcttataagtcttaccttcttttttgtcttcgtggtcaccgatttcaagtgaagtacagtcggcagtcaatccgctggtcagagcagaagaaacgcgcggaccgaggtcacgaccgataacggtagcacccatcaaacagatttgcggttgctcttctttgaagaggttcaccaggatagctgtgtgaggaagtgatgtataagggtaaaggccttcaccgtcgaaaacgtgaagtttatctactccgtaaggaaggatttgtttttcaatatctttgaggccgcttccggcaactacagcttcgagctgacagttcaactggttggctaacgaacgacctttggtcagaagttcgaggctaacgtctgcaacgttaccttcttctatttcgcaatatacaaataagttattcatgattatccgatggtgtggttagctaatagttcaacaatcaggtcttccacgtcacggtcgctgccgctgatggttttgctctctttagcctggaacacgatgttctggatggctttcacttttgtcggcgaaccggacagaccgcattgtgcaaggtcaccgtttacgtcggctacactccattctaccagattcaaataatcacgcttgtcatacaaatcggtataatcaaggttaccttgttgtttttcggtaactgttttggcgtgtttgtatttctgaaccagtttcgcattgcgcggacggcaaggagcggcagaaccgtttacggtaatcacgataggcagcggaccctctacagtttctacaccaccgtcgatatgacgtttcaccttgattttactatcgcccacttccagaatttcttctgcgtatgtgatttgcgtcaatcctagcttctctgctacctgcggacctacttgtgccgtgtcaccgtcgatagcctgacgaccaccaatgataatgtcgcaatcaccgattttgcggatggcagtagccaatgcgtaagacgtagccagtgtatctgcaccagcgaaagcacggtcggtcagcaagtaaccgttatctgcgccacggaaaagtccttcacgaataatgtcggctgcccgtcccggtcccatggtcaggatggttacggtagagcctggatgagcatctttcagtcgaagagcttgctcgagagcattcaggtcttcggggttgaagatagcgggaagtgccgcgcggttaatcgtcccgtcggctttcatggcatctttcccaacattacgtgtgtcaggaacttgttttgccaatacaacaattttcaaactcatgctataaattttagtattagtatttctacaagttagcagccagtagtcaagtagtaatatcttgctatccaaactatccggttaactatcagcgtgcaaatttactcaaacgcttggttctgacaagaaatccgagtaaaaaatgcacaggtttaagatttttgagcaaaagaggagggtttttatagatttaattcagggttgacaaagcgtttatgggcagtctgccggattgtccggcagactgttgatgaattccggattatttgataagttcgtaataatgtgcattcgtgaaattatcattcttgaaaatagccttttgcataattcctactttcgtgaatcccactttctctaatacccgcatggatggggagttatgctcaaatacgactgcgaatacacgtaccttatcagtgtgttcgaaataatagtttatggcttctttcagggcgtcagtaacgattccctggttccagaaaggttctccaatccagtagcctacttctgcactaaaacgttctacatccgtagcgggtacaaaaccgatacttccgactgcttctccgtttacctcaatgcagaaatcttgaatgttttctttcgcttgtaccatagcgagaaaaacattagcatcttcctgactataaggataggggagaccgtcacggcagttatcccaaatattcttgttattgagatattgggctaatgatgctgcatcttcggtttgccaggtacggagagtatagtttttcttctgcacgataattcctgttttctgtaccatatcatcttttattgtataccaatttcagctaaccccatcggttcaccgtcatgtatcatccgtgttgctttcaactgaatatagcgagccttgaccggagtaaagtaaaccgattgcaaaatcggattgctctttatattggaaaattcatctttggctactacctggttgactgcattgctatccatacctacagatatttcgtaggccgcgatcaaccctttattatattcactctggtcggggagatagtggaatgaggtaatcgtgcgttcttctcccaagtcaatcaatagtgtatttccattgatgaaacaggtggtctggtcgtttttatccatgcctttctgtgcttcctctacatctactccaacaagggtgaacgggtaacttttcagttctgcagctttcgctgtgtatgtatccgaagtctctcctgcataatatgcttcaatgttattaatacagagacaagcccgtgaatccgtgaagcggacacgaatcttatccgtagtgattgtttcgaaacgaaggagccgtttatatccgatagtggtagtctcctcattgaacttcacagggatccattcgcctgcctggttatattctacaacgaatgatttgacacgttgtccgagaggaatatattcctgcaacatcatacggttgatcttttctgcctgaggtaaatcgaattcaatagtggctgaaatgacatcatcattggtagcccaataagtatcataatcaccgtcggtcacagctttggcggagaatgttcttccgcgttcgtccgatgctttgggagagagtcctgccagcagattgtgtgccagttgtttttgtacattctggtggaagtttacggcattggcagagtcagtagggtgaatcaatccgtcacggtctaccgggaagtttaataatagcgttgcgttatgtcctacgctgcggtaatataaatcagtcagttcgtctactgttttcacacggtcgtcttcttccggatgataaaaccatcccggacggatggaaacatcacactcagcagctacccattggttaccatcggcatgaccatattgcagttcacgatacttgggatagcccggataaacttctcctgcacgaagaaaagaccagttagtagctccggcaaatccgtgttcgttgcctacccaacgacagcccggacctccatccgagaagatgacagcttgtggctgtaactcatcaatcatcttgtaagctcgcggatagttataataagtcttgcggtcgattgtacggctgtcttttgctccgccataccagccgtctccaccgttggcaccgtcaaaccagatttcaaatacatcaccgtagttggtcagtagttcgttgagttgtttatagaagtattctacatattcgggagagccataattggcctgatgcctgtcccagggcgagagatagactgcgaatttaatgccatactttttgcaggcatccgacagttcgcggacaatgtctccttttccgtctttgtacggagtattgcggatacagtactctgtcagttgcgtaggccacagacagaatccatcgtgatgtttcgctgtcaggatcactcctttcatgccggatttgacaaatgtctgtacccattgctcacagtccagacgggtagggttgaatgttttaggatcggagtctccatatccccattcacggtcgttgaatgtgttaagtccgaagtgtacaaacgcatacgtttccattttttgccattccacctgtttggcttcgggaatgggtaagatagcttccggtgcttttaccgaattacaggcacttagtagaaaaagacctgttgcgaagataagaaagtgttttttcatgggggtgtttattagttaataattgaatgtaagaatcatctacaatgtaattccaactacaaaataaagttgctcttcataagggttggctattagctttccgaagatgggtaaagagaagttggatgttattttaatatcttttgttgcagataatccgatattgactacattgaatttgtcggagtacatactctcccaaggagtgaaacctgcttcgatattcatatttacatccttcacgctgaacgggtaactcaactcgcagtaactggaccaggcacgtttcccgttttcccggtaatcgtttccggcaaaggtagtgtaccagcttactgacaatgggaacttttcgctaagcatatagccggctcctacctcgaaagtgtgcccggtagagtgcgaactgtaattgaagtatttaaaaggttcctcttctgtctgggtaaaatagttattggcgtaaagagtcaggtttttgtattcgtactctagtgataaatctatttcattgttcttttcgcgaaattcggtagaaccccatgcgtaaacggtcagtcctttccagttgaggccgagtgaaggctgcacacttgcattgccgctatccataccgcgccaaatataactgcttacaaaatcagcagttacaaaaacttcttgtgcctgtgcaaaggccgtacaaaacaggatggcaataagtaggatttgttttttcattttatcggttatttcttctcgttttcggggggtaaagatacgcaatatatagataaatgatgacagatgaggagaaaaaagaaaacggctgcattgagcagccgtttcttaagtaattgtgaatcttgaaagttagttagaaagtgacgtccattttcagtacgaaagtacgtggagcagcaactgccattgggcggtagctgtattctttattcaacaggttattcaccataaactggaaagctacttcttttgtggcttttactccgaagcgcacgtcaacagtggcatagtccgtattatgttttttccagtaagtagccagtgtctctccttttgaataaccgaaaaggatgccacgtacataatccatcaggtctttctgctgtttctcgcgttcgtccaacatcagatagtcaactgccagaattttgctcttccatgctacattggcaccgacattgatacgtttccactggaaatctaccgtagctttaaaactgtgcttcgggcgatatttaaggtacttacctgtgttcgatttctctttcatctgaagaggatcggtataaagcccctctactgcattacgttcctgatagtcagcatcgcatggctccgtgtatacatatcccaagttatagaacaacttcgtgttcttattgaaattatacacgccgttcgttgagatttctactccgtaaatctgggctttcgatacattgtggaactgggctccgataccgaaccctttgccatctgtcagcatctggaatgcatcgcctatgctattaatcatcgtgtaattggcattgttgaacagcccgaactggaattcaaccatgtctttatattgtgtatagaatcctgcaacatccacaaaaccctggaaattaccaactttatatccttgcttaattcctaattccgcattaaatcctttctccggtttgatgtccagattaggataaacgccaactccaccaatatccttgcgcaggtatttttcattgatagacggattacggtaaccctgtccgaagctggcacggataaaactgtaatcagccaactgataatttaaccctgcacggaagaccggacggaacggaactttggttccgaagattttagtttcggcttcacggtgatgattattcacccgataatattcggcacgtacaccggcagatacactcaaacgatcccagaagcgctgatcgtattggaagaaagcagctatattatcacttttgtatacctcatccattacagcggagtcatagcggatatgttccagggttactccggtagtgatttgtgcaccgccttcccatttcttattgaactggtagtcgaggtagtaatcgaagttcttatcagtctgtgtttttggagtgtttcgtgacggattgataacatttgataaccacggaatcagatcactcggtaactgtccgttcgtaagtccccctaagtcactcggcactccgttgtccattacccaagagatcagatcgcaataatcggcagtcgtcgcattcgggaaaatattgcctaatgaggtgaacactccgttcatggcatcttccaggttgccgttgacaagtccggaacctatacctaccaatgcaggataaagtgaactgtaatcgccaccggctatattctgtatcgttttggcatcagttcccatatttcccagaatatcagtgatggaagttccttgggtagggcgtacgatattatcggcactgtaatagaaacgtcctttaatcttatgtgacgtaccgttttccggattcacatagttgatgaacggatcgatatggaaattattctcttcacgtcccatgttggtgaaaggagacggtttgtacacttccgttggtgaacgccagataaagaagtcaccatattgattggaaaggaaatcgacattgaaaccataattcaacagtttcattcccatatcaggctgatgataagtgaggctccctcccatacggaaacgtttgttgtatccctgttggcggtatccttcgtcagtgaaaagattgattcctccgctgacatcgaaattgccgatacgacgggagtgggagaggtcgaatccttcgtaaataggattccgtataccgctaagaagacttccgcgcaggatcggtttaacagaatatttatcatctttccagaaactcttgtcgctccattggtattcgtcgttttccgcatcaccatatactcccacataagcactgaaacgtgttttcggagtcagtcccggacgtgcagtacggatgttgataatgccgttcaaggctgatgacccgtacaacacggaggaagctcctttaataacttccacctgttctacattttccaaaggtatggtgttccaattgatttcaccggtttttggattcagggtactcatgccgtctatcagaatctggctgcgtgcacctacaccgtaagtccatccgctgccaccgcgcatagagggctgtttgtctacaatgtctacaccgggcaatgtacggagtgtggaagaaatatctgtcggtgcctgacgggcaatatctccggctttcaccacatccatggaaacagtaacgtcactcaacttctgttcaaagcgtccggcactaaccaccacttcttccagtagctttgtgctttctttcatataaacgtctttcgtgatgacttcacgcttattgataacaattggcatcaatacatcttcatagcctacataactgaatacaagatcgactcctccctcgggtagtttgatttcatattctccattgatgttggacactgctccctgattgccatggagtttgtatgtgacggctgcgcctaccaatggctcattggttctggcgtcgtatatatgtcctttcaaggtttgggcaaagctgcttccgaaaccggttagggataaaaggattatcagagtatataatttcttcattgttcttattctttaatagtatattaattttgaggtacgagatcgagtcccaagtcaaaactttgaactagcaatgcacattccggccaagtgataaatagcatatctattagcggttcgagaaatccggcaagtccggccatttccggtggtaataaacttggcagcatttttaatactatgggatgaaaatctccaagaagctttaatatcggagctattccttctttatcaaggtaaatgtatgagtgaccattttgcatcttgatgtgcataggtattccgtttgataaccaatcaaagaacgttgcaaaagattgatcgttcatgctaacgataaaacctagaatctcattttgcaattgaccgtttactgttttcagaagactcttaagttttaaggcatccatgctgaagatggcatccgagatggagcttatgatgtttttgtcgatcacttttccactgccggaagcaacctgtgaaatgattgccggcagatcgagctttataacaatcttgccatccctttgaaaccagtatgccaatcctttgggagaagtcgtatattgataatctttaatggcatccgtaatcatatcctggtcctctatatccatatttaaaaaggcagtcagaacattaccgataaataaatccttgttttcctcgttaaaagcatctcccgaataattggcaatgatatttccatccggttccaatgttatatctttcaggatgcaaggcaacaagtatcctaataatccctgcagaacacttcccatgttttgaccgttgtagctggtttctgtggcttcttctgtttccggaaatctgaagtaaatggcacatgaagtcatcttgtcatctttttcttcccattgatatccatttccctcatctgcaataacctttcctgttccatgctctacatctgcgaaacgatagttcttagcccataaattagcatttgccatcgttacgtcagccagatttaatataagtctgcctttcactacgcgtccctcataattaaaggtgctttgggtggtagtaccgatgcctttgccttgaaaagagtatccctctgcatctcctgtgagaggtatatgagtcagctttaatgccttttctcccggaagaatatcataaaaagtaagattagctgtctcaccctttactgtgctgaaatctaccgatttcccagtcatattttcgccgttgtataccaaagtcaaggtaggattcggattcgaaaatttattggaataattggccgttacgtctacaggatcggggcctggataatcttcactacaagaagtcagtattcctgttacactcgtgaatataagcgatattataagtgaaatctttttcattatcattctcttttatagtgattggtaattatttggtcgatggaactaagtccaatcctaaattgaataattgcatgagtttccattgttcagcaatcatagccaaatccaatgaaagtcctcctaaatcgactttaattccggatagtatgttgatgacaggagttaatgtctgatagtccaggtatagataggtatgtccatctttggtatgggttatattcatgggaataccatttttgatgcaattgaataaagcggtaaaagaggcatcgtccaccattaccaagtaacctaatatatcattattcacaattgcattaagagtggaaagcagacttttgaggcgaatggggtccgttttgagaatggcttcagtaatcccgttgataagctcaccatctatctgttgctggctattcttaatgatttctgtaatgattgcgggaatatttagttttaatattaacttgttattggcttgtccccaataagctagtccattaggagatttctcataagtacggttttctataacggtttgaatttgtttttgaacaacttctgcttcatcgccattcaaaggtaagaacagtaactcttcatttattggatctgaagagtaatatgctgtaatagtaccatccttttccagtttgatatcttttattaattgaggtatgagcgtctgaagaatacccggggcaaggttacctaagagatacattaatgaagcttcgtcagttcctatcccttctttaggtttcatatcgaaataacaggcacctttgtactgtacaggatgaaattcattcgtaagatcctgaaccatttcataaagagcgaagtcgtatttgttaaccagcttttggggatcagccattaccacattcaaatccagcttcatcgttttcggagtaatgctaccgctgtatttcaccgtagctcctcccatcgtgatatttgttccgctgaaagtgtaataccctttctcttcattctcatacagttggatatgactgataggagtttccttttctccgggaatcacatcattcagtgtcagtgttcccgtttcactatctcctgtcttgaaactgacagtttttccaacgagtttctctccactgtaggttaggtctagcgtatatggtttaatatacgagccatattcctgactaatttctcccggccaaaatagcttgtcattgtaagtctcttcgcatgatgtaaagaaaaataccgcgcaagctacataaaatagttttcgtaagtttctcattttgctttttgtttttattgcgtatttaataaaactttgcaaagttcgactaacaattctttattgtcaaggtctgtttttttattttaatgttctatttttaattgtgtatggcgaaagtgcttaaaatgagaaaataagtgtgctctatttttaatattgattgttcttcttttaagaatggctgtaaaaagagaatgaagagagctctaaaaaagcaaacggtttcccacctgtttttcacaggtgagaaaccgttcgtttttttcttctctatttccgactcttgcggaaagtttagaatgtaatatccatctttacaacaaaagtacgtggagcggcaactgccatcgggcgatagctatattccttattcagcaagttgtttaccataaactggaaagcaacctctttcgtggcttttactccaagacgcatgtcaacggtggcatagtccgtattgtgctttttccagtagctcgccagactttctcctttggaatagccgaaagcaacgccacgaacataatccatcaggtcaagttgtgttttcggacgttcatccatcatcaggtagtccacagcgaggattttgctcttccaggcaacgttggcacccagattgatacgtttccactggaaatctaccgtggctttgaagctatgcttcggacgatatttgagatacttacctgtgttcgatttctctttcatctgaagaggatcggtataaagtccttctaccgcattgcgctcctgataatcagcatcgcgtggttcagtatatacatatcctaaattatagaacaacttcgtgttcttattaaagttataaacaccgtttgtcgagatttccactccgtagatctgggctttcgatacgttatggaactgtgctccaataccgaaaccttgaccgtcagttaacattcggacagcatcgccgatactgttaatcatcgtataatcggcattattgaagaggccgaactggaattcaaccatatctttatactgtgtatagaatccggcaacatctacaaatccctggaaattaccgattttgtatccttgcttaatccccaattccgcattaaatcctttttccggcttaatgtccagattcggataaacaccgactccaccgatatccttgcgcaggtatttttcattgatggacggattacggtaaccttgaccgaagctggcacggataaagctgtaatcggccaactgataatttaatcctgcacggaacaccggacggaatggaaccttggttccgaagatctttgtttccgcttcacgatgatgattgttcacccgataatattcggcacgtacaccggcagatacactcaagcgatcccagaaacgctggtcatactggaagaaagcggctatgttatcacttttatagacctcatccatgatggcggaatcataacgtacatgctcataagtggctcccgtagtgatttgcgcaccactgtcccatttcttgttgaattgatagtcgagatagtagttcgtacttttgtcagtctgcgttttcggagtgtttcgtgttgggttgagcataccggatacccaggggatcagatcactcggtaactgtccgttcgcaagtccgcccaaatcaccgggtaccccgttgtccatcacccaggagatcagatcgcaataatcggcagttgttgcattcgggaaaatattgcccaatgaggtaaatactccattcatggcatcttccagatttccgttgataagtcccgaaccgataccgaccaaggccggatagagcgaactgtaatcaccgcctgcaatattctgaatagtctgggcatctgttcccatatttcccagaatatcaccgatggatgctccctggctggggcgcacgatattgtcggcactataatagaaacggcctttaatcttatgtgacgtaccattctccggatttacgtagttgataaacggatcgatatggaagttgttgtcctcccgtcccatattggtaaaaggagagggcttgtacacttctgtcggcgaacgccagataaagaagtctccatattgattggaaaggaaatcaatattgaaaccatagttcaacagtttcattcccatgtccggttgatgataggtaaggttacctcccatacggaaacgcttgttgtatccctgctgacggtatccttcatcggtgaaaagattcatgctcccgctgacatcaaaattacctatacgacgggagtgggagagatcgaatccttcgtaaattgggtttcggacaccactaagaagacttccgcgtaaaataggtttgaccgaatatttatcctctttccagaaactcttgtcactccattggtattcgtcattttccgcatcaccatagatacctacgtatgcgctgaaacgtgttttcggagtcaatcccggacgtgcggtacggatattgataataccgttcagagccgacgaaccgtacagtacggaggaagctcctttgataacttcaatctgctcgatattctccaaaggcacggtgttccagttgatttctcctgttttgggatttagcgtactcattccatccaccagaatctggctgcgtgcacccactccgtaagtccatccgctgccgccacgtatagacggttgtttgtctacgatgtctacgccgggcaatgtacggagcgtggaagaaatgtccgttggtgcctgacgggcaatatcaccggctttcactacatccatagaaacggtaacgttactgagtttctgttcaaaacgtccggcactgaccactacttcttccagtagtttggtgctttctctcatgtaaacgtctttggtcactacttcacgtctgtcgatcacaataggcatcagcacatcttcgtagcccacataactgaagaccagatcgactccgccctcgggcagtttgatttcataagccccgttgatgtccgacacgactccctgattaccttgtaatttgtacgtaacggctgctcctactaatggctcattggttttagcgtcatatatatgtcctttcagcgtttgagcaaaactgttcccaaagctgatgaagcatagtagcaaagttagaatatatattttcttcattgttcttgtattttcttgtttatagaaaggtgcttcttattagttgttgactgtaaggtctatacctatatgcagtttggtgatggtagaccaacccttataaagcggcatgatataactgtcgaacagcatcggaccaaaattgggaatacctgccatcaaaggttccagactggggaggaaaggaatgaacggagtcaatgcatctttggttacgtacagataagtgtgtccgtctttcttctccatttgcatggggattccctcttttatccagccgaacagcatttggaaagtggcgttatccagacctgccagcatggataatatggaattatccagttgaccgctgatagtacttaatatattcttgagttgaaccggatctgaattcaggatagcgtctgtcaataaagccatcagattctgatcgatacttttcccctgcgatttcatgacttgaatgataattgccggaagatccagtttcagatagaaatgatcgttcttcatataccagtaggccagtcctttgggagatggagcataaatccggtttaccccctccgtggcattgataatatcctgttgctggaaacctcccatcggataaggtaagaataacttatacataacgaatgtagcgactttattcatagattcgggatcttccatgtttatttcactgaacttctgctctcccagcatcatttcatccgttgtataattggctgtgatgtatccgttaggttgtaaggtgacgttatcgagaagctgtgccagaagataaccacccattcctttcaccagccctgtcatgaccgcataaaggaaactgccatcactgcttagttcaatatccatgtctacataaagaggtgcggcaatcattttaccatcggattccccccattcgtacaggccggtatccgaattgcggatcatatcctttcctctgccgtatatgatgtcgctaagtgcataagtgttggccatttgtgcgctgttcaccatctttatattggtcaggttcactgtcaactggccgttttctacacgtccgctataattaaaggtactgccggttaaatttcccgtgccgttgccggaaaaagagtaaccgttagcatctccggaaataggtatatcagtcagtttgagtgtttcttctccgggaaatacattataaaaagtaacattagccgtttctcctttcactgtactgaagtcgactgctttgccagtcatttcatccccatcataagttaatgtcaggttggatttgctcaagtatttattcgagtaattcgctgttacgtccaccgggtccggtcctggatagtcttcactacatgaagtcatcaaacctgccgttccgatgaggctgcttataaatagtatagataatttcttcatattctttatttctttcatattcatggttgatgtttatttcgggggtaaaaggcctagtcccaaatcaatcgtattggcagaattccataggtaaggcaatccattctcgtcatttgccatgaggtatccgagtagattcttgaaggtcgcattgctcgccatgctttccggaagcaatccttccactatcggctgcaatccgggtaataactgaatgaaagccgtggtcgattctttggccagataaagattggtatgcccgttctcttcttccattatgttaaagacaatgccctcggtcagcaagtagaatacttgccggaaactagcatcatccatattagcaatgatgccgaggaactgattgtcgagtatggcatttaaagttccaagcaactttttcaattgaatagggttcgacttggcaagagcttccgtaatgcctgaaatcagtcccggatctatgggagtctcaccgtcctgggtagtcagaccgatgatggccggcagattgaggttcatcttaatctgtccgttgtttgctgcccaggtaatcagattgatgggggaagccgcccatgtgcgatctgccagcacactggtaatgtcgctctcttttaatgtaccaagcatgaacttgatgacaaatagggcaatcgtccccgtatctttatcgggatctatgttactgatagggatactgccaatatataccggactggtagtgtaattggcgatcacgttaccgtcgggttgcaaggtgactgattgaagaagttgcgggatgaaatagcaaagcgcattctgaaccagtttcattctcatgaacagtgtgctgcccgatttggttaattctacatcgtccagatggacatagaatgctccggtcaatatttcactcgatgattctttccatacgtattgtcctccactggttccgacaatcattttcttgcctttcgtaaagccggataaaccgtaactttttctccatttactttgtggcattgctacattcaaatccagtttcatcgttttcggagtgagggttccgctgtatgtcaccgttgcccctttcattgtgatattctttccactaaatgtataggaatctccctgttcacataaatcgatttggataggagttgttttttctcccggaataatgtcgttcagtgtgatggttcctttttcactgtcgtctgttttgaaatcgacagtttttccaacaagtttttctccgctgtaggtcaggtctaaagtggctggtttgatgtatgagccatacttctggttgagctctcccggccagaatagcttgtcattataggtttcctcgcaagatgtaaggagggaagctgtacaagctacataaagaagttttttcaaagttctcattctcttttaggttttattttaatgtattatttaaaacagtgcaaagtacggtgaataggtgactgccgtcaagctccattcttgggattcaatgttctatctttgttattttctaaagaacactcctaataaagaagaaaacaatgttctgtttgtaagatataagataccatttttgaactctttgtttggaattcggatggaatggatatttttgataaactaaaaaactagacgatgataataaacgactcctttcccaaatttgaccttccgattgattttatagcagatgatagtatcactggggatattttaaactattacagtaatttcccatgcaaaataaaagccggtgtctttgtactctgtaccgaagggatggtgaaagctaccattaatttgttggaggttgtcattcgtaagaatgattttgtaattgtccttcctaattcgtttattcagatacacgaagtttcgtctgatacccgcatttcttttgccggtttttcatccgattttatgctttccggcaactatgtggaaatcctgctagactctatgcctatgatcttaaatagccctgtcatttctctgcaagacgatattgccggcttgtatcgaaatgtatatcttttgctgattcgtgcttatacacttccacattcattggaaaataaagacataatacgctccatactggctattttcttacagggaacgaaagaactgtataaacgctatggcaggaagcttgacgaacctttgagaagagagcaggagttgtacaggcagtttatacagctgctgatggctcattataccagtgagcatgaagtggcattttatgcagaaaagtgtggagttactgcagcgcatttctctagtgcaattcggagagcaagcggatacagtccgttggcaatcatcacggagattattatcatgaacgcgaaagcacaactgaaaaccacccggttgccggtaaaagaaatagcattctctttgggctttaacaatcattcctttttcaataaatacttccgtaaacaggtgaagatgactccgctggaatatcgcgagaaataaatctttgtttgcttaaaattgggctatacataaaaacaggatgttttatacattttccctgctttaattagaaccggtgtgagggcagcaattcaaaaggagcttaaatgtttgtttgaagaatgtgaaaaggtagcactttgctgataaatcattctttttgcactaatcttacgtcagaatcggaataaatgaatctctctttttctgatgtatagctatttgccagatcagcaatcagcgaagttagaagtgaaatagcttggaaacgactcttatttcaatctacaaatccttgctcaccgatgaacggtagcttggtcggtgagcaaggaggcgttcctcaccgaccaaggatacctttcattaaaagaacggacgttttcatacaatgaaaaacggtctgtttatcctttatttatacataataaggggtgtgatatgcatattcttgcactaaattaggcattttattttctatttgattcgattcatgaccattgctgaataatagaatcttaaaaatagaacagaactgtttattgctgtaatacagtcgattcaccgataagaatctcccgttcattgattttttttcctttttctgcttctctgtcatacatttgttacagtattgtaacatttgctactctaatcccctatgaatatgaacgagacatgtaatgtgaccaccgcactttccgctttctcctccatttctttggaagagatgagtaccatccgtttgatgaaccgtaccgacacaaagtatatcgtttcactctctgccctgatggacgtattgcaacgggcaagtaactgttatcgtgtgcaggaggtgcagggagaacggaatatagtttatcacactacctatctcgacactcccgattacgccatgtatctggctcatcaaaacggaagagtgatccgtgagaaaatccgtgtaaggacgtatgtctcttccggtctgactttcctggaagtgaaaaataagaataataaagggaggacagataaaaagcggatccgggtgcaaggagtaaactcgttgcgtcaggatggaggagaagagtttcttcgcaattatgcctggtatgagttgtctaccttgaaacttctactggaaaatcattttcatcgtattacattggtgaataaggcaatgacagaacggctgaccatcgataccggtgtgcatttccatcatctcataaccggaacagaagcaagattggaaaatcttgccatcatagaactgaagcgcgacgggagaacttattcacccatcggtgaaatactgcgcgaactgcatgtgcggccttcgggaattagtaaatattgtgtgggaaccgtactcacagccgggaacttaaaatataatcggtttaaacccaagttgagaatggcacagaagatagcaaagaagcaactaatgaatatttaatataaaacctgaataatatgtttgatgaactaagtgatattacattaatagaaacaccattgatggatagcgcaggtttcctggaattgttgttgcgattctgcttcaatttactggtggtatcctgcattattcatctgttttattaccccaagagcaaacggcgtgattattatttcacctttacgctgataagcatcagcattttcctgatgattttcttattgggaagtgtcaaactgaaaataggttttgcgctcggtttatttgccattttcggtatcattcgctatcggaccgagtcaatgcccgtgcgtgagatgacttatctttttgttatcattgccatttcggtaatcaatgctcttgccgtagaaatcagttatgccgaactggtatgtaccaacttgcttttcattgtcagtatatggctttgcgaaagcaatcgctggctgaaacatatctcctgtaaattgattcaatatgacaggatagaactgataaaacccgaaagagaattggacttattgcgcgatctccgcgaacggacaggacttgacattgttcgtgtggaagtgggacatatcgattttttacgggatacagccatgctgaaaatctactatgaaccgctgaaagatgagataaatacgattgatacgttgacccgcttacctaaagaaaatgaataaggaaatggaagataagtcaggcagagaaagtaagaagagactctgggatacaggcagatacctagttggttgcctgttattgttgtgtatggcagggaagagttatgcacagggagatgatttcggcgtgtggaccagtgcggaagtgaagaaaaagatattctccggtttcgatgcttctctggaaggtgaattccgtacaagagacggattgcagacggtggaacgctggtcgggttcggcaggtgtttcctataagatgtttcgttggctgaaagcatccgcaggatatacgtttattcattattaccatccgatggaagtcactaaaaaaggaaactatatccccgaatattggcagccgaaacatcgtgtaaacttgtcattaacaggaaaggtggactggcgccgcttcacgttttcccttcgtgaacggtggcaatatacttatcgtcccagtcagtcggtccccaaattcgatggtgatgacgggagtgtgaagaatgatgaatatatcagtggaaaaggaaaaaatgtgcttcgttcccgtcttcaggtggaatataatatacgtaaatgtgcttttacgccttatacttcatgtgaactttcatattcgttgaatgagatcggtgcttttgaaaagttgcgatggacattggggacggaatggaaactaagtaagaaacatgctctcgatttttattatctgtatcagaataaggcagacgacgatgaggcaaacgggcatgtgatcggtgcaggatattcatttaagttttaatatataaaacgggaaattatgaaaagaatagtgttgttttggataccgcttttattgctgttgttggtgaattgtacgacggaatcattcgatttcggcgatcaggaaggaatattggtcgaaggttcgggaggtggaggaagcagtcagcccaacccgacgattcccgagggatcggaagacttattgggatttacaatcgcttttgatgaaagtgataggacgacgtatggaagcatgtcggaaacggtcacttccgatgatgattttatagagaactcccaatttgcctccgtggtgacgattacctataatggaacgactgccacggtaggtaatggagtttccggagtggaagtatcttccaatggggcgcatattgtggtcaattctacggtcagcggagtagagtatgtgttgaacgggactactacgaacggctcgttcaaggtatacagcgaaaagaaattcaaattatcactggcgggggtgtctatactcaatccggtaggtgctgccattaatatccagtcttccaaacgtgtgtttgtggtatgcgcggatgaaacaacgaatgtgttgacagatgggtcttcttatacggcaactactgatggagaggatatgaaagcctgtctgttcagtgaggggcagctcattttcagtggaggcggttcactcacagttaccggaaattataaacatgccatcacaagcgatgattatgtgcgtttccgtagcgggtgtaatattacggtagtttcggccaaaaaagatggaatccataccaatgaatctgtgattatcggcggcggaatactgaatatatcttcagacggcgatgctattcagtgtgaagagggaggaattacgatgaccggaggctttgcaaaactctctacaacggataataaagcgcatgggttgaaatcctgtctggatgtggtaatcagtggcggtgctattcaggcacaagtggcgggagcagcctccaaaggaatatcctgtgatggtaacctgaccatctccggaggaaagctgactgcattcacttctcaaaccgctctttatgaagataatgatttaagttcgtgtgcaggaattaaatgtgacggaaatatcctgattacaggaggcgaaatcgctattcagagtacaggtggagccggtaaaggtatcaactgtgacggttcgattaccatcaatgacggcacggtgaaagtgataactaccggtacgcagtgtgtatatggcaagctcgactcgtcggcaaaaggaatcaaagcggacggtgcgttgacaatcaatggaggaacggtgcttgtgaaggctaccggtggggaaggtagtgagggtatcgagagtaaaagtgtgttgactgtcaatgagggtacagttgccgcgctttgttacgatgactgtatgaatgcaagtaacagcattgttcttaatggtggcaatatttattgttatagttccggaaatgacggcattgactctaatggtacgttgaccattacggggggagtgatcgtatcgtcgggtactacttctcccgaagacggattcgattgcgatcagaatacctttaagattaccggggggattgttctgggtattggaggaggaacaagtacacctacatcaagtgtatgtacgcaacgcactgtgatctatggcggttcgggaagtaacggagaaatactgaatatccagtcggccgacggaaccagcgtactgacctatcagattccccgtgcttattctcaaatgacggtattattcagtagtccgaatctgacctcgggcggtagttatactatctcaaaaggaggaacggtttccggtggttccgagttcttcgggttatattcgggagccacttattccggtggcacacaggcggcaacatttactgccagttcgatggtgacacaagtcggcagcacttccggcggtggccagcccggtggtggaggcggtggacatggacctggtggatggggatggtaaacagcagtttaccgtcgaaatccgttctttggtcgattctatttgtgataaaacaggttcggttttatctttgtttcgataatcagaagcaatgaggcatgaaaagactgcgtaaacaacacgtgctggagcagagtatttacggagctatctggatcgtaatatttcttcttccgctgataggcggatactttgccatgagtggaggacttgaacgggaggaaacccgtatggtgatccgcgaatcatggttgagtatccttccttttttcgtgcttttcctgttaaacaattatgggctggttccctatttcctttttaagaaaaggtactggcaatatactgtttcgttgatttttgtaataggaatgatttgttggctttctccgttttcttttgccaatcattcccccaaagatttcaagcgaggagagttgcctcttcgtatgaaggagaaccggagagaccagattattaagatgagagaaaaggcgagggaggaaggggatgtgcattggtatgaatccaatcccgaacaacgtcctaggggaatgggagatccaaatggtcccggaagatttccaaaaccgactccttttccttatcctccttttgtgctccgctatcttattcatttcatcattgcctttttgatggtagggttcaatatcgccatcaaacttttctttaaatctttccgtgatgaagaaatgctgaaggaactggaacatcaacgtttgcagtcggaactggagtatttgaaatatcagattaatcctcatttcttcatgaatacgctcaataatattcatgcgttggtggatattgatacggggaaagcgaaaagtacgattgtggaactctctaaactgatgcgttatgtgctttatgaagcgagtaataaaacgattttgctttcacgtgaggttcagtttcttaaaaattacattgccctgatgagtttgcgctataccaacaaagtgtctattcagatggattttccggtcgaagtgcccgaagtgcagattcctcctttgctttttgtctcttttgtggaaaatgcttttaagcatggggtcagttatcggagcgagtcttttattcatgtcttgatgcagttggatgagggcaaccggctttcattccgttgttccaacagcaataatggttcggctgacgaacagcatcatggcattggacttgagaatatccgtaagcggttgaggcttttatttggcaatgattatacgctttccattaccgaagaggaacataaatttgatgtcttacttattatacctttattagaatgaaatgtatagcaatagatgatgagccgttagcattgacgcagttgtcggattatatatcccaggtaccttttttgtctttggtaaagtcatgccaggatgcgttcgaggcaatgaagatattgtccgaagaggaggttgatttgatctttgtggatattaatatgcccgatttgaacggattggatttcatacgttctttggtgaaccgtccgttggtgattttcactactgcttattctgaatatgcggtagagggtttcaaactggatgccgtagattatctgctgaaaccgtttgagttccaggatttattgaaagcggcggataaagcccgcaggcaatttgaatatcgtttgttggaacaacagggtgaaataggaaatgcttcgcagataaaaggagattcattattcgtgaagagcgattacagagtggttcgcatcgatgtgaagaatatccgctatattgaggggatgagtgagtatgtgcgtatctttgtggaaggagaggacaagcctgtaataacgcttgccagcctccagaaaatggaagaacggcttcccacgcatttcatgcgggtccaccgttcttatattgtcaatcttcgcaagattaccgaagtttcccgtcttcgcattatctttgataagaatacttatattcctgtcggtgataattataaggagaaatttacggaatacattgggaaattaagcctttcttaaataattatttaattcccagttttttggcaatttctttaggaagtgcatctttatgcaccaggatattcattgtcttgtaggcaacgaatgctttggaagcataccagataccatcatatttgcctgatttaccccaagagtttttcaccatgaagtattcttttccgttctggtctttagcgataccgtagattaccattccgtggtcgtctgttgtttcccagttgtcaaaagcaacttgacgcatttcctgggtaatatccttttcagggaaaggtttggtgaatagttctctgcgtttgtcggcggcagtcaatcctgtccaacgggccatgtctgaaccggacagttcagattctttggctgcatctggcattacggcgataccgtcacgtgagaatccttgttcgctgacatcgctaccccatgcaaaggtatagcctttctttactgcattgtccataacagccatcagttcttcgataggcaggttgtaagacagaccattacgccagttatcctgaatttcgatggcgaattgagaatagaacggatggtgtgtataagaagtcagtgatacatagtcgttatagttcaatcccagtgattcggcaaaagtcttcggagtatattctttgcctttgtaggtgaacttctccggacatgctcctaggtaagtgtcataaatggcacttagtccgtttttccataccggagtcagtttgcttaatttaccttttgcaatcgcattgatataaccggaagcaacagcatccagctcattatgtaccggcagcgtatcaccatacataatacccggcatcacttcttgcggaacgataccataattcttgatgcaatacattacatcataaaaacttccacccggagagaaagaactgtcaccgtgataacgtacatagtttactccgcgatcctgcatcgttttgtgtacaacaaacatttcagacaggtcgtattcacctttacctaaacgaagtagttctgattcaacaaatccgagagttgagaaactccagcaagtactcgaacgattttggttcttgatagaagttatcggattttctttcactgtcgtgaaaacaaaaccttcttcaggttttgcatcttgtgccataacacttaggctgaacaggcctaaagcagcaataaggattgtctttttcattcctatgaaattaatattaaattgttttggctacaaatataggaaagtttcaccacagagtaacacagagtttcacaaagttttctcttttttcaaatggacagctatcttaatgacttccgtttaatgacattttattgtatcttggcgcggtaagttcgctcggagaaagtaatattcaggaacagggaaaggctgttttctttttgcataccgttaggaattttcatctggcctttatatttcaatccgatagaaaggacgttgttattgcgcaatccgaagttaagtccggtactgacgtaatattcggttgcctttttcttttgaatgacgatataggaattattaatacctgttcccaataggatgctgaccggattacgatagacattgcccaatgtatatcttccaccgactgataaccggtgttgattctcaaaactgacattggattgggaagattgcatccggctccagtccacatatttgtagtcgatggttgccatccaacgtagagtgttgtaggaagctccgagcccaaagaattgaggaagacattggcgatagcgtttcaggcttttttcaatatcatctcctcccgaactgctactaacgtataagttattatcctgcttaaaatcctgcgagtaaccatatacggcaccggcaacgaaagaacgttcgcggtctatagcccatttatactgtacaccgaaatccgcataaaaagtatgtttgtaggagctggtttcttctgtggcagtaccttgcgtctccgtttgtgtgatggtccccgtcacataagaaagattggtgccgacagaaaatctttttccgaaaaggtaagccgtgctgatacccatcttggaaagtcctccttcaccctgaaagagagaagagatagtacccccattggtgcctgccacttcttcatccagcgtgatggcatatcccacactgctgacgggagccatgaaaattgctccataccagcgtggcataatccggcagccgatacttaggttattcagatttccggtgacggaacggttacttgctcctcgttgtgaataaatctggtatgctcccatgataccggcatcgatctggaagcgttgttcggtcaactctgtgagtgaagccggattggcattgttaaggaaattatttcctcgcaatgcaatgcctgtgccgcccagtccggcatattgcccgccttccccggtagaaagttctcccagtccgaacatggaagtaggggagttcgttgtattttgtgcaataactatagagacaggagtatagaatgccagaaggcaaaacaaaatctttttcattgttgataagttttgtaaagtatgataagtttggtattctttttattggcggtatgttctccgtcgccgaaaataacgccttgaagtgtggtatagaacaagttgtccggaagaaataattgtagtttctgacgatcatatccggtagttcccaggtttgtttgcaggaaagaggtgatgtcaaaagagtaataagtctcctcataagacatctcgtcgactactagatttccgctttgtacggaactcccggtgaggtcggtgattacactttgcgtcacattttcattgttggcggtgtagagagccaggcttttgggcaacgggtacatgccgtcataagttccttttaccggatataactgtaacgttgcgctctcgatagtcacaagctctcctttttcgcagagattatttaaatgtgggaagtcgatggtgacatacatacctgtcattccctgcaggtaaacctgatgctcgctttttccggaagagtattcattgccgtccccactttgcaggttggctatcgggatgtttgagcggtcttgttctattttgttgtaagtcagcgtgctgcttgtattgaaaaccagtgttttttcgttcagtgtttccgtaatctggtgatagtagaccgtgatgcacatactggagtcgttgacttgaaatccgctgatacaagcgtcatttgcatcgggtataaaagcaattcccttgaaataatcatggaagaaatcctgggattgtacccatcggccatcattcagcatcaagttgaaccattcttctccccatgcatccggcaatcgtatttccagttcttcgctcggtgagcccggagtaggacgaaagtcgaaagatgccagtggagtttcgttgtaataggcagtagtagtgttgtataggtaccctctatcgtccagttctatattctttgtcagttcatgcagatgaatgcgttgggtttttagtgtatctcccaggtaattgcccgaagaatacaggcgtatggtgatcgagtcgaactcatattggatgttttcatcaaaagaataggaaggtacttcatactctgcgtaaaaagaggcggtaattttcccccataagttgtcgtcacggtatcctatctggcaaaccgtatctcccgaagtggctatggagtcgcttaatactgtactaagtaataccgtacaagtatccatctgttcgttgaggaatgaactttgtacccatttcgctcctatggacgatgaatcgtctacacaagcgaaaaaagaaagagatataaagaatgaaaaaagtagtatgattgacttcatgtagtaaaatgaaattggttttgtaccggcaaaagaagaggttttaaatagtcctccaaaaaactatcgactaaatctctgtatttgtcgacctgaattttgttggtagatagaatgtctgtatttgtcgatagtttttttatgcgtgcccgttgccgcctacatttgcggttgtaatcaacgacatatttatgaatacgaaaatgaataaattactttgcatgatggtggtgctgctttcattggcggcatgtacggatgatactgaatatacggcaggtgtgtggtatcgccgttctgattttgatggtgtggcgcgtacggacgcagctggttttacgattggtaacgtagggtacctctgcaccggataccgggggagtaccaaagaccgtttgaaagattgttgggcgtatgacattgaggctaattcgtggacacagtgtacatcaatgcccgatgcagctccagcccggaatgcagctacaggttttgcagtaggtaccaaaggatatattgctaccggttacgatgcgacaaaaaaggattatctgaatgattgctggcagtatgatcctgccacgaattcctggaaggagatggcttctattccggatggaactgatgggactaatatctatggtaaacggtattatgcgctttctttcggcattggtcagtatgggtatctgggtacaggttacaacgataattatcaaaaggatttctggaagttcgacccgtcggtgggagataaaggagaatggacagccatgagtggatttggcggacagaagagaatgggcggtatggccttcgtcatagatgatatagcttatatctgcggcggtgaaaataacggttcggatgtgacggatttctggtgttttaatccggcaacgggtacttggaaagaattgcgcgaactttacgataagagtgatgatgattatgacgacgattacacttctatcgtccgttcttatgcttgtgctttcgtgatcgatggtaaaggataccttgctgcggggcagactgctggtggtagttatcgttccaattattggatttacgaccctctgacagacctctgggatggggaagatttgacagatttcgaaggaagtacacgctcgaaagccgtatgcttttctactggaaaacggggaattatagctacgggaggagcttctacttattattacgatgatacttgggagttgaagccttatgaatatgaagagaaataaaaaaataataggtattagttgctttgtcttgctgcttttagtgggaatcatatatgggtatatgcattcgataaacatatatcggctggaagtaacccagattgaaggtagtggatacggttataagatttatgagagagagcgtttgataatcgttcagccttttatcccggttgtatccgggaaaagaccttttcaatcggtgcaagatgcccaatgtatcggaaatttagtgctggaacgaattaaagccggaaatgaatttgccatatcaaaggctgacctggataacttgggagtagtgtattaatgccaccatgttggcacagtcatgccacctcattggcacgatagtgtcaacatggtggcactgttgtgccaatacgatggcacaaactaaagcattaagtacagattatttcttctcttcttctttgggtgcaactacataatcttctttgataaactcatcatacacccgcttgggatgatcgaatggtgcggttccattcttctgctcattgaagttttcccggcggaattgtttcagtttcaaattatcttctgcatactccctcaatttcttatgctcatttccataaagcgaactttcagttacgtcagaattgagcaggttttctttaggagtgatagtaggtaggagcacttgttccaacagaccacgataggcaccgttatattcgcaccatacgatatcgttggctacaaatatacgataggagtacttagaccaggcagttttgatttcaatagatgtagcataaatttcaatggtagcttctgaaccatacgcttggtcacggatcacaacggtcgtccgaccgctaagttcttccttcacggaagtttgccacttatcagagtgtaagatctcttcgataatttccggcaaattttctttaatctcaaactgtattctcatggtgcttgcctgcgggcaggacttttttgattttttcctccttaaacaattaagctagcctaaagttacatagattgaagcaaaaaaacaagattttatttgagaatttgttattttcgccaaactatctgcctttttcgtttgtttttaccataaatatgcacaaatcgtaaaaataaagtttatgcggaacagggcccggaagaattatgtcatttatgtactgatgttactcctgtttggagggttgatttatgttgctattgaagagggtgaccggttttcgcactatgcggtaaatgcgcagaacatggtacaggggaatccattcactatgtttctccagtttatacaggataatcttcatcatccgctcactaccttgttgattcagattatagccgtactgctgatggtgcgtctttttggctatttgttcagtctgatcgggcaaccgggagtgattggagagattgttgccggtattgtgttaggaccttccgtactcggctttttctttccggatgcttttcatttcctttttccggcacactcgcttaccaatcttgaactgttgagtcaggtgggactgatcctttttatgtttgtcatcggtatggagctggatttcagtgtactgaaaaataaaatcaatgaaacgctggtgattagccatgccggaatcctagtacccttcttcctgggtatcttgtcttcttactgggtgtacgaagaatatgcagctgcccaaactccgtttcttccatttgccttgtttataggtatttctatgagtatcaccgcttttccggtattggcacgcatcattcaggagcggaatatgacgaagacccctttaggaacgctgaccattgcttccgctgccaatgatgatgtgacagcctggtgtctgttggctgtggtgattgctatctccaaagcaggaagttttgccggcgcactttattcagtggggctggcagttgtctatattgcggtcatgtttttggtcgttcgcccatttctgaagaaagtgggagaagtatatgccaaccgggaagcaatcaataaaacatttgtggcatttattctgctcattcttattatttcctcttgtctgaccgaaattattggtattcatgcactgttcggagcctttatggcaggggtagtgatgccgtccaatctgggtttccgaaaggtgatgatggagaaggtggaagatatttcattagtcttctttttacctctgttctttgcctttaccggattacgtacggaaatcggtttgataaacagtccggagttgtggatggtatgtttactgttggtgacggttgctgttgtcggcaaactgggtggatgtgccattgccgcccgtttggtgggtgagtcgtggaaggatagtttgacgatagggacattgatgaatacacggggattaatggagcttgtcgctttgaatatcggttatgaaatgggagttcttcctccctctatattcgtaattttggtcattatggcgctagttacgacctttatgactactcctttgcttcatttggtggaacatattttcgtacgtcgagaagaaaaattatctttgaagcacaaattgatattttgtttcgggcgtccggaatccgggcgtgtgttgctgtccatttatgatttgttatttgggaagcagttgaagaaaaatcatttgattgcagcacactatacggtgggtacggatctgaatccgttgaatgccgaacattatgccagcgagagttttgctttgctcaatcaacaggcagcgaaattaaatatccaagtagataaccattatcgggtgacagacaaacttgtacaggaaatcatccactttgtccgtaacgaacatcctgatatgctgcttttgggagccgggagtcattatcgttcggatatgccgggaactccgggagcaattttatggttaacgctcttccgggataagattgatgagattatggagcaggtgaagtgtccggtggccgtatttgtcaatcgtcagtatcgggaaggcacgacggtcagtttcgtacttggcggaatgattgatctgtttcttttttcctatttggataagatgttgcagaacggacattcggtacgtctttttctttttgatacggacgatgaagagttccgtggacgcattgacgatttgcaggtgcgttatccggaacaaacgatgatagtgtggtttgagggagtagaagatttagtgactgaagagaaagacggattattgataatgagccatctttcttatacgaaattatccgaggatgaggctgtgatgcgtgaattgtcatctttgctggtaatccgccggaataagaatacgggagataaaaatgaaggacttgaaaattgatgaatctacgggattagtgttggaaggcgggggaatgcgtggagtattcacctgcggtgtgcttgattattttatggatcacgatatccggtttccctatgcgataggagtgtctgccggtgcgtgcaacgggttgtcgtatgcatcacggcagcggggacgtgccaagtacagcaacattgacttgttggagaagtatgattatatcggtctgaaacatttgctcaaaaaacgtaatatactggactttgatctattattcaatgagttccccgaacatattcttccttacgattatgaaacatattttgcttcaccggagcgttttgtgatggtgactacgaattgcatcacgggagaagccaactatttcgaagagaaaaaagacagtcgcagggtgattgatattgtccgcgcatccagcagtctcccttttgtatgtcctattacttatgtagacggggttcccatgctcgatggaggaattgtagattccatacctttgcaaagagccattaaggatggctgcacgagaaatgttgtggtactcacccgtaaccgggggtatcggaaagattcgaaagacattcgtatcccttcgtttgtatatcggaaatatccgaagttgcgcgaagcgttaagtcggcggtgtgctgtttataatgagcagttggaaatggtagagcgcatggaagatgaaggacagattatcgttattcgcccgttaaaacctgtagccgtagaccgcatcgagaaagatgtgcaaaagctgacagagttttatcaggaagggtacgaatgtgcgagagccttacttgaagaataaacaagtctccatagttgaacaatagacaggccctccatgctttttggtttttcttgaatgtcgataggataattgaacgtgttcccttttcattttgaatgggtatattgttctgcagccttttttagtttcctacccatcaattctaccagagtcttcggataaagaacttgtattccctcggcatatctgaagaatactcgttctaactcatggttgatgacgacttcaatttccagtatgacacttccgtcagccaatctttccatcacttgttggctgcggtgtataggcttggttatgatgtaaggtgcttcggcagccgctaccttgaaaccgactttctccgctacacttccggtgtttttagtgactcctaccagatcatcgaagaatgtgttcggatcgaagaacgtattttttatgtaatgttcttgtggcagaacttccaatgattgtattctgtccaaagctaaattttgcaagatccgtccgtttcctctgacaccataaacgaaccatcggttgcgatattcttttaatagataaggataaaaaataaagctgttggccgaacgtgccttgaacgaacgatatttgagctgtatcggatgctcgtttacaatcgcgtgatagatcgtatccagataatccagtcctttcaatgattcattcttttcaaagtcaatgacaggagtggttttcatccgggcagaagcgacatggtcttccaggcggttgataatatcgctcatttccgtaaaataggaaaagcctttaaactgcctcaacacttccactgcttccgacatcgttttcaggtcttgttcgttcagcggagtttgtgtaatgctgtattccggatcttcgtatttatagtatttattttcgtacaccacaatcggagcgttataacccagcttctcgctgcgcatcatctgtatatccatttgtacggtacgtttgcttatgcctttatcgatgccttcgtattcataaagagcatccgagcaagcatctaccaaatcttccaacgtccagcgtcgataaggattacgcagacagttatcaattgttttataacggattaaggcatttctatttgctggcataagtagaagaataaagattggcttcaaaagtagaaaaataaattcaggaaaacaaagaggttacaggtctttattcttgtaatatctccataaacaggtatatttttctgttacatttctttttttcttttcgattaattcgattttaagtctttattaattcgattttgtggagtttattaatggattcctctttattttgccgaaaaataattttcagctatgaggaactcaattgtatatttttgcttgttggtttgttgtattactgtaagggcagaagaactaaaactttggtatagtcatccggctgaagaatgggtggaggctttacctttgggaaattcccgtttgggagctatgatatatggcaatccgttcgaagaggagatacagttaaatgaagaaacagtttggggaggcagtccatataggaatgataatccggaagcttacggcgttttgtccgaagtgcgaaagcttatttttgcaggaagagagattaccgcagaaaagttatggaaagaacatgcttttaccaaacagaatgggatgccttatcaaactgtcggtagtttgaagttgcactttcccggtcatgaaaagtataccgattattaccgggatttaaacattgagaatgcggtggctactgtttcttataaagtgggagatgtgacctatacacgtactttatttacttctttggcagataacgccttaattatacatttggaggcggaccgacctcattctatcgcattcgaagcatcttatagcacaccgtttgaagaaagtgctgtaattgcgagcaagaaccgattgactttatctgcaaaagcttctgcacacgaagaggttccggctgccattcgtttggagagtcaggcgcgtataaaaacttccggtggtaaggttgagagtgataacggaaaattgatagtgacggaagcggatgtggtgactatttatgtttcggcagctactaattttgtgaattatcaggatgtctctgccaatgagagtaaaagggtggacgtgatattgaatcaagttggaaaaaagtcatatagacaacttttggacagccatatcgggaagtatcaacaacagttcggaagggttaaactagacctgggacattcacttgcttcacaaaaagaaactccggtccgtctgaaagaatttcgtgaaggaaaagatcctgctttagtcacactcatgttccagtttggacgttacttgcttatctcgtcttcgcagcccggagggcaacctgccaatttgcagggaatatggaatcaacatcttttggctccgtgggacggaaaatacacaataaatatcaatactgagatgaattattggccggctgaaataactaacttgccggaaacacatgagccgttgttcaggctagtgaatgagctcgctgaaacaggtaaaaaaacagcgcagactatgtaccattgcaatggttgggtggctcatcataatactgacatatggagagcgacaggaccggtggacggccctttttacgggacatggccgaatggaggagcctggttaagccagcatttgtggcaacattatctttataccggagataaggacttcctgattaagaattatccggtattgaaaggagctgctgacttctatatggatttcttggtggaacatcctcagtatcattggctggtgactattccatctatatctcctgaacaaggagcgccaggaaaggaaacaagcttgacagccggctgtacaatggataatcaaattgtatttgacgtgttgagtaatactctgcaagctgcaaagattgtaggagaagatatagtttatcaggatagagttaaaaaagtactggatcgtttgccgccgatgcaaataggtaagtataaccaattgcaggagtggttggaggatgtggatgatccccaaagtgatcatcggcatgtatctcatttgtatggcttgtatccaagtaatcaaatatccccatatgcgcatcctgggttatttcaggctgccaaacgttcgctgctctatcggggggatatggcgacgggatggtctatcggttggaagattaatttatgggcacgtcttttagacggcgatcatgcctataaaattatagggaatatgcttaacctggtggaagaggggaatccggacggccggacctatcctaacttgtttgatgcacaccctccttttcagatagatggtaactttggttttacggcaggagttgcggaaatgctgcttcaaagtcatgataatgctttgcatctgttaccggctttgccaacagcttggcagaaggggcatatatctggtttggtggctcgtggcgcttttgaggttgatatgagttgggaaggaggagaactgttggctgctactattttatcccgtatcggaggtaatttacgtatccgaacctatgtacctcttgagggggaaggattgaaagaagcggaaggcgagaactccaatcctttcatgagcagtgctgatataaaagagcctttgctggcatcggaattgtgtccgcaatatcctatgctgtataaggtttatgaatatgatatagtgacaaaagcaggaggtgaatatatcatccgaagaaaaagataatataacgtgaaaaacaaaggtatatggtaaaaagatttaattggttagttttttgtctattgttttcagtaggtatgatggcaaaaagcgggggtaggcaatataactcttacaaagggttagtgatggccggttaccaggggtggttcaatgcccctggtgacggttccggccgtggatggcatcattataatggtagtaacggtttccgtcccggttcttgttctgtggatttctggccggaagtgtcggaatataagaaactttataagacggagtttacttttgcagacggcaaaccggcatctgttttctcttcttatgacgagtctacggttgatcttcattttaaatggatgaaacagtatggactggatggagtgtttatgcaacgttttgtagcagagattcggaacgagagtggtttgaaacattttaataaagtgctaaattcggcaatgaaatcggcaaataagtacgaacgcgctatctgtgtgatgtatgatttgagtggaatgcagctgggagaagaaaaactattattaaaagatattgatgaaatagcaaagcgttattcattgaaagatcatgcaaaaaatccctcatatttgtatcataacggaaaaccgttggttacagtatggggagtaggatttaatgataaccgcagttatgggttgaatgaagctgaatatattattgatggtctgaaatctcaggggttcagtgttatgctcggagtgcctactcaatggcgcaagctggaaggggatacggaatcagatccacgcttgcatgaactaatcagaaaatgtgatattctgatgccttggtttgtggggcgctataatgaaacgacctatcccaagtatcagaaactggtggaagaggatattcagtgggctaaaaagaatttagtcgattatgctcctttagtttatccgggtttttcatggggaaatatgaaagggaaagaacataattcgtttattccccgtaataaaggctcttttctttggaaacagctgatgggggctattcgtgcaggtgctgaaatgatttatgtagctatgtttgatgagatagacgaagggacagccatctttaagtgtgccaagaaagttccggtaggagaaagtctgtttgtccctttggaagaagaagtggaaagcgatcattatttgaaactggttggtgaagccggcaaggtgttgcgtaaggaaaaggcggtagcgtttgatgccagtttgaatcctgtagctccgaatccttttatccggcatatgtatacagctgacccttccgcacatgtatgggcagacgggcggctgtatgtatatgcttcacatgatattgctcctccacgtggctgtgacttaatggaccgttatcatgttttttctactgacgatatggtgcattggacagatcatggtgagatattaaattcctcccaagtgccgtggggacgtaaagaaggaggatttatgtgggcgccggattgtgcttataagaacggaacttactatttttactttccgcatccgagtgaaacgaattgggacaatagctggaagataggagtggccacgagttgtagaccggctgaaggatttgaagtcaaaggttatattgaaggaatggatccattgattgatccttgtgtttttgtagatgataacggataggcgtatatttataatggtggcggtggtatctgtaaaggtggcaaactgaaagacaatatgatggaactggatggactgatgcagccgatggaaggattggaagacttccatgaggcaacctgggtacataaatataatggtaaatattatttgtcttattccgacaatcatgatgaaaattggaatgacggcgtgaaaggagacaacaggatgcgatatgctgtcagtgattcgccattgggaccttgggagtcgaaaggtatttatatggaaccgacggatagttataccaaccacggctcaattgtggagtttaaagggcaatggtattctttttatcataatagtgcgttgtccggtcacgattggcttcgttctatttgcgtggataagttatactacaatccggacggaacaatacagattgtaaaacagacaaaataagagagtaaattcagttagaaagtaataattatataaaccataaaaaacatgaagaacaaattaaagtggatgatggctgtgggtatgttatcatgctcggtagcaatggcccaacagcaaagtgatatcatgtctgtgtctgcttcaacaaacgtggagaatgcagctttggcttttgataaaaatatgaaaacgatgtggacgttgccttctcaggctttgaagtccgggcagtggttgatgtttactatccagcagcctggagacgtttacgaactggagcttcagatgcagggaattaataaaaaggaattgaaagacgcattggatatctttgtcacttacgacccgatgaatctcggaaatccgataagctaccagatacttggaaatgaaaaacagatgaaagtcaagtttgccgctcctaaatacggtgctcacgtaaaactggactttaaaccgagtaaattggataaacctttttctttaaaggagatatcagtgcttgtggcagagaaagtgttgaaggataataaaggagaagtaactgatcgtcgctatatggatgcgtcacttccggtagaagaacgcgttgaaagtttgttggctgtgatgactccggaagacaaaatggaactgatccgtgaaggttgggggattcccggaatacctcatttgtatgtgccgcccattacgaaagtggaagctgtgcatggtttttcttatggtagtggtgccactatattccctcaagctttggcaatgggggctacctggaatcggaagttgacggaagaagtagcgatggtaattggagacgaaacagtagttgctaatacaaaacaggcatggtcgccggtattggacgttgcacaggatgcccgttggggacgttgtgaagaaacatttggtgaagacccggtattggtgtcacaaataggtggtgcatggataaaagggtatcaatccagaggactgtttactactccgaaacattttggcggacatggtgctcctttgggtggacgtgactcacatgatatcggtttgtcggaacgtgaaatgcgtgaagtacatttggttccattccgtcacgtcgttcgcaactacgattgtcagtctctgatgatggcttactctgattatatgggtattcctgttgccggaagtacggaattgcttcagcagattttgcgtcaggagtggggattcaatggttttattgtcagtgactgtggggctattggtaacctgactgcccgtaagcattatacagcaaaagacaagatagaagctgctaatcaggcgttggctgctggcattgctactaactgtggtgatacttacaatgataaagaggtgattcaagccgctaaagacgggcgtatcaatatggtaaacttggataatgtatgtcgtactatgctggccactatgtttcgtaatgaactttttgagaaaaacccttgtaaaccgctggattggaataagatttatccgggttggaattcggacagacatagagaaatggcacgtcaggctgcccgggaatcaattgtaatgttggagaataaagataatttgctgcctttgtcgaagacgttgaaaacaattgccgtactaggtcccggagcggacgatcttcaaccgggcgactatactccaaaattgcaacctggacaattaaaatctgtattgagcggaattaaggctgctgtgggcaaacagactaaagtgctttacgaacagggatgtgactttactactccggacgcaacgaacattccgaaggcggtgaaagcagcttctcagtcggatgtggtggtaatggtgttaggagattgttctaccagtgaggctaccaataatgtgcgtaagacgtgtggagaaaataacgattgggcaactttgattttaccgggtaaacaacaagaattgttggaagctgtttgtgctaccggcaagccggtggtcctgattcttcaagcaggccgtccttatgatcttctgaaagcttcggaaatgtgcaaagctattctggtaaactggctgccgggacaagaaggtggtccggcaacagcagatgttttgtttggcgattataatccgggcggtcgtttaccgatgacttttccgcgtcatgtaggacaacttcccctatattataattttaagacttcaggacgtcgttatgaatatgtagatatggagttttatcctctttatcgtttcgggtatggactgagctatacttcatttgaatattcggacctgaagatacaggagaagtcgaatggaaatgtgatggtacaggccacagtgaagaatgtaggaggttgtgctggtgatgaagtggcacagttgtatattacagatatgtatgctagtgtgaagacccgtgtgatggaactgaaagattttacccgtattcatttacaaccgggagaatcgaaaaacgtttcttttgaattgactccatatgacatctcactgctgaacgaccgtatggacagagtagtggagaaaggagaattcaaagttatggtaggtggaatgagtcccgattatgttgcgaaagacaggatcaaagatagtgttggttacagtgacaacaagaaaggtgttacgggaatgcttgactacactcacgaatttggtgcagactttactcttgccgtatctaaggtagaggaaaatctgacgaacaatcagaagactgtatggataagcgtaaagaatgtcggaacgttgatggatacaggtaaggtggaaatgtttgtggacggaaagaaggctggtgatgtcgttcactacgaactggctcctggagaagagaagttgattcctttcaatttgaacaaggataatgataaatcggttgcttttaccaccaaatataagatgttacctatttgagaatgagagtatatttatttgtttgtaagttgtgcagcatattattctgctgcacttctttatttgcagcagaaaaggacgaacgcgaagtgtatatgcactttattatgaacggacagagtttatctacaggacaccagtcttatccggtaatttctacaaagaatttgaaaggaaattatatgttgggcaatcaggtctggataaattacggcaatatgcttgaagaacggtttgaaccgttggtgggtaatatttctgtagcattccgaaatgaaaagtttttcaagagtcggtcggcaggtactattgcagagtgtcctttgttgggtgctgtgaatcatatccggttgaaacaccctcgaatggataagattctggctacctcggtaggagttagcggagcaagcgtggaggaactctccaaagagtcggaaacccgtacttattataatgacttccggacttcattggaattagcctcgaatgtagccggcagtatgaatgggaaaatgtattgtcctgttatcttttggatgcaaggtgaatttaattatgatccgaatccggaaaagggattgcgtgccaatgtgccgaatactacggataagcaggagtataagcgactgcttatacaattgaaagataatatgcagaatgatattctgaaacaatacggtcaacaggagaaaccggtatttatcacttaccagaccggcgcgcaatatatgcgtgatacgcttgctatttctatggcacaacttgaagcgtctaatgagtatgctgatatcatttgtgcaggccccatttatccgatgacagaccgtggcggacatttggatgctaatggctatcgctggtttggggaaatgttgggaaaggtctactatcagacaaaggtgcagggcaagacctttaaacctttgcaacctaccgagattatgagagagaagcttcccaatcaggtgcgtatcaaatatcatgtaccggttccgcctttggtatttgatgttcatctgttgcctaaaatccgagattatggttttgaagtatatttgggcagttaccgccaggagaatcggcagactgtcacaaatgttgagatagacggggaagatgtcgtgctgagttgccagcaaccgctgcagggggatgtcattgtggtgtatgcaggcacaaactcatttattgaggaatatcagggaggaaaagacagattgcagggacatggaaatttgcgtgacagtgattcgtataaggctttttttaactatctagatttggatgagaaaaataaggacggttctttcatctatccgcgtgatgactctgaaacgacactgcgaccggagtatgaaccagaagacaggagcgggaaggtgatatacggaaagaaatatccgttatataacttcagtgtaggatttttttacaagattccgacaggtaaagataaaataggtatttccatgtagggaagaatcatagttgtaaaactgaaaatatgaaagaaatacataagtttgtattggcgggcgttctgtgcggagcgtcttgtctttttacatatgcacaggaattgtacaagaacgagaatgctcctgtgcacgaacgggtggcagatttgctttcccggctcacggtggaagaaaagatcagtttgctgcgtgctacttcgcctggtattcctcgtttgggcattgataaatattatcatggaaatgaggcgctccatggagttgtccgtccggggcgctttaccgtttttccgcaagctattggattggcggcgacttggaatccggtgttgcagcaaaaagtggctactgtcatttctgatgaagcgcgtgcccgttggaatgaattggatcagggaagaaatcagaaagagcaatttagcgatgtattgactttctggtcacctactgtgaatatggcgcgtgatcctcgttggggacgtactccggaaacttatggtgaagatccttttctgagtggggtgatgggaacagcttttgtaaaagggttgcaaggagaagatccccgttatttgaaaatcgtttctactcccaagcatttcgtagccaataacgaggaacacaaccgttttatctgcaatccgcaaatatctgaaaaacaattgcgtgaatattatttcccggctttcgaaatgtgtgtaaagaaagggaaagctgcttctatcatgactgcttataacgcattgaacgatgtgccttgcacgttgaatgcctggctattgcaaaaagtacttcgtcaggactggggattccgaggatatgtagtttctgactgtgggggaccttctttactggttaatgcccataaatatgtgaaaacaaaagaaacagctgctaccttgtcaatcaaagccggactggatttggaatgcggtgatgacgtgtatgacgaatatctgctgaacgcctacaagcaatatatggtatcagatgctgatattgattctgcggcttgtcatgtgttggcagcccgtatgaaattgggaatgtttgacagtaaggaacgtaatccgtatgcccggatttctccatcggtcattggctcgaaagatcatcaacaggtagctttggacgctgctcgtgaatgtatcgttctattgaagaatcagaaaaatatgcttccattgaatgtcgacaagttgaaatcaattgcagtggtaggtattaatgctggtacgtgtgaattcggggattatagcggtgcgccggtgatagagcctgtctctgtcctacaaggcattaaaaatagggtaggtgagaaagtgaaagttgtttatgctccttggaaatcggctgctgacggtctggaacttattcagggggagaatttcccggaaggattgactgctgaatattttaataatactcgtttggaaggtataccgaaagtgcgtaaggaaggttggattaattttgaacctgccaatcaggcaccggatccgtttcttcccaaatctcctctttccattcgttggacgggtaagttgaaaccaactatttccggtcgttatacattcagttttacttcggatgacggctgccgtttgcgtattaacgaccaactgctgattgatgcatggaatggacattctgtggctattgactctgtctccattgaactggaagcagggaaagaatatcagttacaggcagaatattatgataatcgcgattatgctatcgcaaaactgcaatggaaagttccgcaagcaggaaaagctacccgcctcgatttgtatggagaagccgggaaagcagttagcgagtgtgaaacggtggttgctgtgatgggaatcaataagtcaatcgaacgtgaagggcaggacagatatgatatccagcttccggcggaccagcgtgagttcttgcaggaaatctataaggtaaatccgaacattatcgttgttcttgttgcaggaagttcattggctgtcaactggatggacgaacatattcctgccatcgtgaatgcctggtatccgggcgagcagggcggaacggctgttgccgacgtgctgttcggcgattataatcctgccggacgtttgccgctgacttattacaaatcgttggatgagctgccgccgttcgatgactatgatatcacaaagggacgtacttacaagtatttcaagggcgacgtcctttatccttttggttacggactgagctactcttcttttaaatacagtgatttgaaagtaaaagatagtactgataaagtaacagtgtcttttcgcctgaagaacaccggacggagaaaaggagatgaagtggcgcaagtatatgtgcgaattcccgaaacaggtggtatagttccgataaaagaactgaaaggtttccggcgtgttcctttggaaccgggtgagagtcgtgccatagatattgaacttgataaagaacaacttcgctactgggatacgacaaaagaacagtttatactgcctgcgggtacatttgatgttatggtcggtgcatcttccaaagatattcgtttgcagacgataatcaagttatagacgttgcttatactcggtttaccgggataaattccttttttggcagaaggacaaaagaaaaaacagtatctgcaaagctaatttgttcttttgtccttctgtccttttgtctaaaagatttaattcctgcccatgcatcttccggttttactgttatggaaaagatatacggtaagatcctgattcttgaagctataatgtctgtcttatacggtgttgatttttagtactatatcagattgaacttatttcttatgatcattgaatctacctcttatgaatttgattatgttatcttgggtatcagatatcaaaaagagaggaactgtatgtataaatatagctcctctttttatttgttactgttttctacttttatttgtttctatatacctatttattactagtcagatagtttatcatatttactaccaatttgcctgctattgggtctgttatcgctttctccgtgcacatggtagagatgattgctactcccttaccgtcagctatttgtaacatggttagcccgcgcatggattctatccgttcgatgcggtcttctggtttgccaccgtcgatgtaagcatgaattttcatttgtcctgctagttctgtgacattcttatggcggtgagctttcaaagttgctgtacatgccatgggaatttctcgtttattgttattgaaatagcgcagttccagtacatcgatgtcgttaaataccggagcgtcattacgttccatgattacaatatcgccttccgtcgggattatccatcccgtgatatattcgggatatacggttttggcagtttccttgttgttgaggaaaagaagttttccaccttttgactggtaggcacggagcaaatctttttcttcatcgttgcaagttgtcagaccagagatgacacaaaggtcggctttcagtttgctgtcgagcaattctttaacggaagaaaccggttgatatttgatattaaggaagtcgaatacagctttcgtgttatccttatccagcaatacaatctttttgctgttattcacctgacctgcgttccactctttacgtgcaagcagtagttcgtattcattggcagaaataggcaagccgttttctgtgagtttcaatactagtttggtttttgtcttattggcaggcagggtgttcggtaactggatatttggctcgatatagtgtcgtgcataatgctttacggcaggaactttttcacaaccgcttgccagacactttccggtttcgtcttgtatttcccagtgaagcagggaaggtttcaaatccgtaccgtcttcacggtcgttcactatatagatgcgtgtaggcaacttttcaccggcatacaaattgcgtccccacaactccgcactgaccaatacaggttgcaaagcccgtttcaaagcatagtaggtaggatacggctcaatattctgatagtcgtatgtctgacggaaccatgtcatcaatgcgaagtgcatgattcccgaagcttggtcgttggaacggcggagtgtttctgccagttcgcccgtaatgaatgcctgcgttttcaggaatgagacgggatctgcccaatcataagcttcatatccgattaaggtataaggattctgatggatgagttggtaagaacgggtaggatgtcctgtctcgttgttgggatagccagtagacatttcttggctgatgagtggacgatcggccattttgaactgcttttggaattcaccattgaagaaacggaaaagcgaaaagtcataccagttatagtagccgtgcatatcatcaatatcaccatcatcaatgctgttcataaagtcggcaccatatttcttatccttgttttttgcttgatagttggagtcgaaacagataggacgggtagggtctatacggcgcatctctttcactacgtccgagataattcgatacttttctttggcacgttccaagttgttatcattgtcatagaacttcatctcgttatttactgtccagaagagcagggatgggtgattacgatattttttcaacagccctaagaattcgttacgccacatttccaatagacgacaatcgggaatgggagtggaatgaatcatcagccatgaccatgtgccttcaaatgaaataccgatgccattgcggtctgcggctgtcatccaaagtttgttccatggagtagtatgggtacgggtaacatcaatatttccggctttcatcagttgcatgaacgtatttgccagattttcatcgttgggtgctaatgcgaatgggatatgatttcctccacgcaaccagtacttattgccgttcaggtagaaaagtccgtcttttacttcgaacgtacggaatccggaagtctctgtcagacagtccagctcagtccctttgcctgtgatcaggcggaatttgaaatcatacagattaggatgctgcggtgtccataaacggggttttagattatttatggtataggtttctattcgttcttcgcctgtattgagacgcagttttcgaatggataatccggaataaagtactgcaccggtttctttgtcaataatatcagtataaagattgaattctttctgtttattatcataattttttagagtgacgtcgaaggtggcgccattcaaagtaggtttgataaatacatcctctacttttgtaggatcggtgatacttagttttaccggttgccagattccggctggttcatccccataaaaaccatgagggatttctttcaggaacacattgttgtccactttcactttggcatcttcttgttcactttcgcgtacggaagagtagaaaaaatcaatggcatttgctgattcggaggtacttccgtccattttgcgcatcactttaacggtaatcagatttttgccgggttttagtaaccggctgccgtctgcccggatttcaccgtacataccgatgtgtgaggttgctaatgtaccgttaatgtatatttcggctgctttagagactgcgtcgaacgtcagtatcagttttttgccttctatcccgggtggtaattccagccattggcggtaccaagcgtactttgtccggtgataatcgaatgtgtagttttcgcaacggtcagtttcctgttggtagtatgtgtccgatacgcctttgggttgtgcgcctttgggagaaggcattgtttcgccgtgcagccagatgcggatcggtgtccagaagttagggacggacataatgtgccaatcctgatcattcgtttctgtcgatatggctttgttcttgttggctagttgatagtccggcatgaataaccagttgccattcaacgtgatatctgtgcggcttccggtgagtgcttccacttttatgggggtataagcagcccgttcttgacggcgtttctcctctttttctgccggagtcgctttttgttgatattctgctacttttacatcctttagtgcgttatccgccatcggtgttacggtgaggtcgtcaaactcggtctctatccaaccgcctcccaatcctatttctcccaacggaaccagattggcgttattgtctgtaatatctatatgaggttgctcctcatcgttgaggaatatacggatacggtttccgcaaacttccactttcatacgataccattctcccggtacagggtggaaacccaacgggcgaacacccataaattcgtctgttcccatatatccggtacgcattaggtagaggtcgtcctgtaatccacctttgatacctaccacgtagcggtcgaaacggttatagttacggaaacttgcccatatctgcacttggtctgcatttttaggagcacgggctttgaaagaaaatgtatagtttttccattcgggcttgccgaacaaagcgtaagcgttttgggagcggaatacgttgtcagcaatgctgcacgttccccggcctactgttttcaatttttcaccagtattggagaagtcgtttgtccatgtagtttggtcttgtgcctgtacgctcaagcacaagatactatatacacaacttagaaatgctttactgattttattcatatatattataagctgatgtttagtatagaaacagccatgttggaaaccagagcgtagagctgatgatttcgcgacatggccgtttaatttatgatcaagaatgatttatcggttgttcagtaacataagagcccacctttgattagcgtagtctgtattgaacagaacctggaactggaggtttccgtgctcatccggagctatcgcttttttgattttgacgataaattggttttcatctatcagttcgaaatgatcctgtgtctcgctgttttcaataaagagcttcaactctgctttgtttttgcagaaatattgtttacaatggtcggtgatgaccaaatttttggcggcatcactgtattgtaccaataccggcagtttcgtgctgtttgtaggaccaccacatacatcgtatgggaaaccttgtctccagaacgagttgttgaaagccagaccaaagttatattcttttccttcttccaagtcactgagtttgttctttgtcggatcacctgttaaagctgatacggagagggcatagtctaccggagtatgttccactgctccgtctgtaccaaggattctgccgtcggcgcatggttgtttgtcgtagcagagatagagaaggaatgttcccggattacggacagggtctttgataaaccaacgttcgtcaccatttgattgagcttgttgtccggcttcttctcccgccttgaatgtccatgagaacttgataccgcagttatccccattgctgaagttttcttggttcaggaaattatagttagccagctcataggtgttgcttagtgtcagtgtgcctttggttgcattccacttaaagttgccatcccattgttctttggtcttgtcattctgattgttttgatctagcgtgaatataaattctgcatcggcgggtttgaagtcgtacagactactgagaggaacatttgtgaagttgtatcctaaggtcgtgttgtattcgccgggaattgcatattgtttttctttgaagaacttcacagaattgtgtttggatgcgctttctatttggtcgatgttacctttgttgtagatatcaactagcatttcgtctttcttcaccgggagggctaccacatatttggtagatacattattcagatagattcctacttcattttgatcagcatttgtaaaaaggactttgtccgttcctgcttcgttcatggcaaatagattggcgccttctacacctgcgcattgcggacctacgagcatatagcatttttttgtggcggcattgtagtaaagacacatttcaccagcacccagttcgctttcttctgtaatgcttcccaaaggtgtatccatcttttgtatattccaagtatcattttcctgtgagcctactttccatgcttgggaactagtgatacctaaactttctaatgatgtctgagaatttttcacttcgataactttcgttgttttgtagagagattctatgttactcaacataccgctaacggcagacaaagaaacaccgctcttggctgttgcttcatccagggagtaaacagagatagtcttctctatgatgtctttttcattttctttagcgtcttttgcaccgatagtgtaagttactttcactttaccactcttgttagcagaagtagcagtcagcattccgttttcaatagcaaatgcatttccagggttatcagatatttcataacttctttcaaccaccaggtcattgaaacctaattcgtccacaaactttacttcgcctgtttttccgaatccccaatctattttcttggaaagatcaacgctttcagtactgatgaattgtaatgattcagagtctttataaatatcacgggtttcacgataagcccatacaccgtctgttgcactataagacgtcggtttcactacgaaataatctgaacttgttgttgctttgtccaaagtaatttccaatacggcaccataatattcggctgtcatatcttgtggagtaagttctacggtcaggatgccgttttcgtccagcttgccttcattgactacatttacaagtaattgtgggagctgtccttcagcacgtgtcagtgccagttcgtgaatatcggcgcaagcgaaagaggcttctttcaagtctatgtctttgggtaaaacccggaatttggcagtagccttgtttgctgcgatgatttcaccggcagtattcgtatagctggctgcttccagaaaattatcttcttcgaaaacatactgtttccggaatagaatagagctgatgccgctgaacccgccgccttgtaccgggagaatgtagttctcgccgtaaagatagatggagagcgttttgttttccgtgtttaatgccataatcggagcatctttagtaatgctgatatttgtcttggtagcttcgctttccgatttgttgatgaaaataaaaccagtttcatagtcataaaagaatatgtctttgtctgttccgggaatgtcctgttcggtaccttgtgtctttacattgtaccaacctgcacctttgtcgctgctgtatttccacacaccgtcttctattttgaactgatagaaaggcgtggactgtccggaagcctgcaaacgaagttcgtctccgttacttaatacaatggtatattgtgagaagtcatcactaggataccaggaagctactgttaaattggcatctaaagccgcttgaattttctctttgaatctttccatatcagattcaaccgttgaaatacggttatccaggcctgcgatatcgtcgtcgtaatccttacaggaaaaaacgcttgttcctactgaaagcaacagtgctccatagaggagattgttcaataatcttttgttcatcatagatcaattttagtttaataatttatttgtttccttatttatttgtgataatttctacataattcaaactgatagctccttcgattactgccagattaaagtctgcatatccacgtgtgtcccgggtatagactgccacttcggtttcttcccatgcattgccggtagccgggagtgtgactttttgcgtcatctcgttaccgatttggcaacatacggtaatttcaccttcacttgcataacggaaacggataatagactctccacttctgaagggtagttctttccatctcaatgcattcaatccgtcggcagtgagatctgtatgccagcccccattatattttgtgtcggaacaacgtttcacgacatactgctccggagcgttattcattttatcttcttgttgtgatgattctatttttttgtcagatatggtaccttggtaacagtagtcgcaagcttcagcctccagtttttgttcggtcgggaagggatgattgccatacttacgaagcaggttgatgcgctggttagggtagtcgtagtaggtcttatccatactgcgccaccaagctgcgttttctacaccgtctgtaaatccttcgagaaatacgagatttggcttgaaagtcaggaatgattcaaacatttcagtggcatattctccatgtctggcatcgatgaactgccattgtgtctggctacggtcaccttgtacaaagcccggacaaccgctacccacactgaatcctttgaagttgtaggcggatacataggtattatatttcatttcttcttcaaactgttttttttcttcttcggtcatacctacttttgacaaaggagctgcaaaccagttgtgaatggcgtctacataaggacaatttactaatgagaagtcacggtctgtccattctcgttggatgatgaggaatggacgtacgccatattcttcgttaaagtcatcgctaaggcatttgaggatataactcaatttaccgttgtaagcatctgctttcgtataatcaagtccggtagtacttttatagttgtccggatcttgttccgttagttctccgagataggaatcttgcaggaagccgttggggttccaaaaatagatgacgggacgtccgtctatttcgaaccaatattcgcgcggcacatattcgaatgcttttttcagattgaagtcccatatatattgatagatgtcgttacggaacttatttccttcccctttggcatcttctttttccggatccatgaaaagtagcggatactcggaacctatgtaacggttgggaccattcatcggtttgtcggcatatccgaatcctttatgcgcattgcgggcagcagcccatgaagcgggagtatcatcgaaaattgcgattttaaatttatgcgccacgcctttgcgttcgatagcggccattaagtccaaaagtttgtcgggacgtccgtggtcaacattatcattcgccataccgcggcagttcatggcaacataatcctgaccgctataagcaatttcttctacaaagttgtcccaccagtcttgttcggtaatgttgcccggtagcgggtcttgctctcctgcctgaccgggaaatgctgattctacgtaacggtagaacagtgagcggttgtacatggtagaggcatcggtgtaagatctatccatttgtttacggatttctccttcaaatcccgccaacgtgcctagtttgtaagaacgggtgatttcctgttccgttccttgtccgccttcatatcccggttcaccggaattttgtccgccatccggattgtcgtccgaacacgcccagcagaaagctcccagacctagcagacaaatgtatttccaatatttatttttcatattcttttcgtcattaaaaaagttaacgtgcattcttagtttttcttgaattgctcacgggtgatttgcaggtatgtctttccgtatccgttgccgtatccttctactgtcggttcaatgaatgaatcaaagttgtatttattgtaggaatcaatgaaaatcagccggttgcgtccagcattcattttggctacgttacaaatggtacggtaagtggcaggatctcttttcacaatcggggagttgccgatagcgccgcgtccatcctgtatcagtttgttccaacccggccctacagtaggaataagttccatactaccgtcaccaaaggcaggcaatgccgtttcacggttgtatttccaattttggtctatcatctgcggatacatgtacgaacgggttacttctgattggtcatacatgttgcggcttgccacagcatctacaccacctgacatgtagaaatattgataacgcatctggttgcaccatacatccgcactttctgctacaatataaatgtcataacctgtagcttcttttaccgccctacggatactgtcatacatggcttttgaatcttttgcatagatttcggcagtcttatttttgatgtagaccataggacgattgcctcccaccttgtagtaaccttcgtcggagaaaaaacatttggctatttcacaaaaaaagttgttcagtaactcctgacgggtgtaattgactccttcatactctttacctgctacatcttcgatacagttgcttgaagaaagttgtggcggcaggtcgacaatagagttccagttaatgctgactactattttcattgttttcaaatcaataaagtccctgcctggttgtcccatgtgcggcattggcagtttgttcccacctctgcccgaacgtcccaaaaacatagtgacgagcaaggagtcgcttctgttgagacgtgtgccgggaccttggttgatatcggctcccaattccggtagaatcataaagtttgctccggcttctatacaaccgttcacatgttgctgcaccatgggtatcatgcggaaactttgatcgtcaccttttacttcgagtaaaccttcctgttgcgactcgggcatgatctgtggagtcaggttgttgtagttggtctttgcgcttagttcgctatcgagcttcgtcagaagctcccaacgggtaaagttcggctcaccgtttggcgtttgagccaaatcaccgttcttgttgtagaaaatgcctacctgatagtcttcggtgacaggaatttccggaatttcataattcaagaaatagtcatcaatgctcggtccctcttccttattacatgctgccagaagaagcaaagtcaaggaacatccggtaatgtatttcaatcctttcatatctgtctatttaataattgattatttgtcttcttcaatacgtataaaattgatacttgctgccaagcggtcttctccttgcagatgtgaatactcgggatagtctttcagaacattatcgtagaactcttccagtgtgtcaccataccaatgagccaccatttcattgttgtacatcaaatatccttctttccaacggtcgtacagaccctccatattgtaagatccggcaaaagcaagcggagtgtagaagttgtcgtcgaaagcaccgtcgggacggggagtcttcgatgcggattgcagcatccggcaggcttcccggtaatagttcatgttccagttacgttcatctattggatattgcaatcgttcgggaatggggtcgagcaagttggctccgtaggttccgtagttattttccggattgttgtagaagaacggagggtaattcatcacacgtgttctgcgttccagagtccaaccggcatatccgttgaagtatgtagcgaagtaacgttgtttccatacttgttgcaggttgtttttgtagccgcccttaccattgatgtcagctttataaaagttgcgataatcatggcatcccaaaccgtttgtattccattttatgccgtcgcgttccaaatattcggagatgcctgtagtaactccgtactcgttcatggaagcgttaataccattataatagtattgttcggcactttgcggaagagctacgttgataccccattcttccttgcgtagttggatttccgacaacatgaagtttacttctgcccatgtcagcagttttatagtcgcgtcttgcttgataaagtcgcgtggaactagcgcataagtatagccttcgatgcttacagaggcggtggaataaaggctttgcagatcgttgttgtgttcatccttaccagtaagccacccgcttggtgtttgtttcatttcaaaacgaggaaggtatggaatacgataagatacttgtacgaaccgtttctcttttgtcgaccacaaagaatctcttactaccgcacgataatctttctctgactcgtatttggctcctacggtattattattgcgtgattgttgtgcatatttgcttaaacgtggatcttggaatgaacgcatataacagaagaaatattcattcatggcagggtaagtcaaaccaccaagttctgtttccagttttgttcccaggtcgaattctttcaatatacgttcataatatagagacacatcggcattagggtccgttccataacgtcctgctgcattgtcatcattggatgtaaacagataattacggttggtcgggttcaatgctttttcaatctgttcgcgtgctaatgtggtagcttcgggattttttttcatattcatcatgcggatagctatatccagacgtaatgagttggcaaacttgcgccatttttcgatatcactttcaccgcctgttccggggtaaaaaggatctttcagcattttttctccttcggggtcgaatatgtctactgctgtgtccaaccaacggagaatttgcatatttacttccgcttcactgttgtagtaatatacgtttccataggtttccttgcaggctgcatccattggtactggtccccaggtggtggtcagtacggagtagagatatgctttccacgtagtcagtatcgcccagtagtttccgttggaatcacggtcgtacttttcttccatgatggctatgtcgcccagcactttcttatagaaattataaaatctgtcaccgatattgtccatgcttttgggggcggtccatgaaactacgtagcgtgccatatagccatagtggttgtagttcatttcagacaatacattcagtgatttgtagatgctacccggaaagattttttggatatctatatcatccagataaagcttgtcgggatttcgattggttgtgtcgaaactatccacgcaagatgtaactagccccaacagagctacggtacatagtgtatataagtactttttcattgttgatactgttttagaaagttatcttaaagtcaaaaccataagtggcggtcggcagattgaagcctcgttccagaccttgttggattcccatggatgaagttgcttccggatcgatacctttcggggtattctggtggagaatagctacatttctacctacagccgaaattctcatggactgtatgaatccgatctttctcaataaacttttcggaatattgtatcccaatgagatttctttcagtttcacgtaagaagcgtcatatagatatagctcaccatttctgccgctatcgtttgtccagtagttgattggttcgatccaagcctgacatggttgtccggccagtccaggtacggaagaatcataaacggctccgggaatattcattcctttgggacgggaagcatccatataaatattactcatgccattgggtacatatttggaatcaaggataccaagatagccggtctggtcgttttcattcaaaattgttttggagaagaagtgtgcttcacgtcctcccaatgacatgattgtttctgcgttacgagaacctacgaaagctgtttccgaccatacgttacctcccatacgaatgtcgaacatggcggagaaggataaatccttccaacgtaatgaagtacgtatacttcctgtccatttcggttctacgtctgccaggaacttagcttcacccgatagagggcgaccgttagcacctaccagtacttgtcctagttcgttccttttccatggttcgcggcaatagaggcttactaaaggtttaccttttacaatacgtaattcaacactgttttgtacactagtcagtgtcatgtaatccataccactagccagtgaaatcacttctgaattatttttggcccagtttacgtccactttccattcccagtccttattttggaaaggagtgacacctaatgtcagttcatatccccagttctttacttcaccggcattgaacaatgcttctccgtatccactaactccattgatagtggaagtcaggatttggtctttggtattcttgttataataggtgaaatttaaagagacacggtctttcaggaaacgaaggtcgaaacctgtttcaaaagaggtcgtactttctggttttagcgcgttggtcttgcgcttattttcactttcgaaccaagccatatctcccaggtaagagttattgtaagtgaaaccgtttagtaactggtcaaaaccagtgtcgttacctactttggcataggaaatacggaacttggcataagatagccaatctttaggaatactttttactaactctgtcaacacgaaactcgtaccgtaagaagaataaaaataagaacgattatcggaaggtagggcagatgaccagtcattgcggcctgtcacgtctacatagatgaaatctttgtagcctaggctgactgtaccgaacactgcctgtttctttttagcattgtattccggccatgttttaatggtagcgccattatttgtcagagaaataaagtcttttgcagctaatgtcccaatttccgagttccctttcttaaatacgaagtcctgcatattggcgccggcactggcagatacattgaaacttttccaggtcttgttgtaagacagcatggcttcgtaagtataattgcgtgctttttctgtaaattctttgtaatagccatctgcatcgcctggagtatacatattacggaattcatatccttctttcatattcaggtcgagtgctgctttcaggcgtactctcaagtcatttgtgatactgtaattcagcgtagcgtcagccagtaaccattctcctttgtcttggttggagagttcattaagcatccataccggacttctgaactggagagcggtcggtttgccattttcgtctttccatggatacatttcgccaacggagaggtcacggggcatatttatcaaagtatagatcggattacgatccgagttgttacgatacgaacgattgtttacatgttcatgagtataacgaccattcaagtcaatatccattttttttgtcaacttgacattggtacgtacactgaatgaattacgggtaaggttgttcagtccttccaatacgtcattgctacgtaggttagtaaagccgatacgggtggcaacgtgttccgttgcacgttcgatggaaatgttgtttgtccaggcataagcggtctgatacatggcggtcgtgttttccggagtagggaggtagggtttgatttgtccgtttcgacctactacttgcattcccagcattggcataccccatgaacgttcgtcgtagccgccgtccagccgattgatgccgtagggaagattcgggttgtaaggaatcttggtatcgttggcaaatgtattggctttgttgttctcgaactgattgatatgtccgctgccatatatgttctgataaataggatattgggaaaactcggtgaattgtacgtttgtagaataggaaatgcctaatccggaacggttaccggctttcttggttgtaatcaaaatggcaccattggcggcatccgaaccatagagcgctgaagcattggcacctttcaataccacgatactttcgatatcatcggaattgatattattggcagggttaccgtagtctatttcaccgtcttttacattattaataataggtacaccgtcaatgacgtaaagtggttggttgttaccagaaatggagttggcaccacggatacgtacggtagccgaacctgccgcaccgttggagattacttgcaaacctgccactttaccttgtagcatattgacaaatcctgcgtcacggttttcggtcatactcgtcacatccattttttggaaagcggtagaaagagacttttcgtcacggcgcaagtccatcgctgttactacggtttgttccagcatgacagcatcttcttccaacgtcacgtccaatacactttttccttttgctacattatatgacttcgtcttaaagccaatgtaggagaactttaatacagcaccattttcaggaacctgaatggagtattttccgtcaaggtcagtaatgacacctttcgtgccgcccactatcacaacgttggcaccgataataggttcaccttgcacatcggtcactgttcctttcaccgttcgattctgtgcctgcataaccgaaacactaaacagcatcaaaattaaaatgagatttctttcatagtatctcatgtacttggaaaatcgttgtttcatgtttttcatgaatttatttatgagtaatcactaaattaagaatgattggatgagggaaaacaaaatattttatatccttcatacgaattaaattaagaggtccttttttgtttcataatacttttctattaagattaatttttctgcaaatgaactaaaagacaataaaaaaggaaggaatttacgattaatcggggattaaaaaacaattaaatgtgaattaatcacagctttttcttagaatgtgactttcattttattatttgctgcatttttaatgcgcatatacttatgaactataggagaatattattgaatatgagcaataacaatgtactgatattggctcatttttatactgttttgagcatcattttgtgatgcgtaatcctcctctataaagttgaaaaatataaaaacatctgccacctgcaaccaaacgcatataatacgctgattggtaaatagttgtaccgttgcagatactgtggcagataggtggcagataaagtatctgcaacacattatataactgcaatttcgtaagtactctgcatcgtttctcctttcagaaggaggggaagccagggatatacagacttgagaaacttgagttatataatcaaagaatccttgatttcttaatgcaaagctatgggataattgtggcgtttctacgagaaggcgacagtatccttacgtggaaactacagtttcctgccttgggaactatcgtgtcctaccttggaaactcccgtgtcctgccgtggaaactgcagtttctaatgcctgaaacgacagtttcccgcttggaaacaggaagttaatgcatacaattgtacttttgcactcatggagacttggtttatgtaaggtttatactgcgttgcaggtactttatctgcaacgtatctgccacagtatctgcaacaatgcaactgtttatcaattagtgcattacgaacgtttggttgcaggtggcagatgtttttatattttttcaactttatagaggaggattacacatcacaaaatgatgctcaaaaccgcatcgattttactcatttctgcacggtaatggatcagtataccaattggctgtggcatatattgcatagtttaattgatatatttataaattacacctataaactaacaaatggtattttataattttctcccatagagtcgcggtattccttgcagaagcggtcatatacatttcgggcaatacctttctttccttgtgcggagagtacggtacatttggctgccaatgcttcttcattaagtgggtcgtgcaagaacatgatatcagcaagacggatgatcatttcttgatgatttcgttggatttcgatttccagtaaattctttagtaagtcgatagaatggctggagtaggcatccttgaaatcgtctaaccagtcaaaaactgtatttggcaataaaggaccatacaataacaattccaatatccggttgagtaattcttcacttttctcttgttcaaattgtttggtacaggtcattaaggtatgataatcacaaaatacgcttgttccccatttgatgcgcaggaagttattttctgtcactacttccatatctccaatgctttctaataatacccgcaatttgcgcagattgacattacggttgttacgggcagcggtttcttctttgtcaggccatagtatttcagttgctttactagcaaggataccttgaggatttttctctgtatagagtatcaacaaaataagcagatgtttcaaacgaggtgtaaaattggaggtgatgtcatttccttctttatcgcgtacgttgaaacatccaaataaagaaatagatgcgcggtttcgatcataatagtcggcagttctcgtcagggtggtttcaaaatcctgcctcttttcttgtgttacctgatattctggtatttcaggttgtttccgatcgatatgactttctataacagataacttttcctctctggttttagtaaccggtgtactttttttctttttgctatattttgagcggtagaatatagttccacttataatgaatagcaacaagattccggcaatataaaagtatttccggctggaagtaaatgtttcattttccggttgccggatatcttcttcgtttacgagaggcatattgatggaatagatggctacattatgtgtatggtcattttgtattttatccaataccagaaataatttaccatgtgaaggggaagtataaagactgaagtcacaatcttgataattcaattcgttgtgtatgggtttggagacttccgtgtagacagaatctttcatggagattttccacaatatgccgcctttattcattgaaacggcatagaaagaactatccgacggttcgaaatacatggaagaagccataagggttccatcttctggggacatgtttttttgccagacgatacgtgaccgattgtttttcaagttgattgcacataacccgaggtagaaatgtgaactcaactcctgctttccatatttattacctcttccgccaaaaatatacagttcatcgcctactatagtcatggcggcggaatagcggggatagaggggacgctcatatatcacttgttctaatttgtaatttccggacttcatctgaaagagatcattacggtattgataaaaaccataaccgccgaaaaaatagaaagaagagtctgccggattaaatgttctggcgtgattatagttgctggcttcctctttgtttcgctcttcattgctccatttttcggtatcgaacgagaaataagaagttataccccttttgagatggtaagacactatcttgttagttaaagtgtcatacaattgatgattgggatattctacggcagggaaaccgccacgtatcgttatttctttttgtaatgttcctttttcgtccagaacttcaatggattgtggtttgactaagtaaaataaagcatcacgagcattgaatgatacatccagtttgccaggaatgtgagcttgatgaataagtttccattcgatatggttgtctatcagccatattggatgaagcgcacgtgctattgcattttcctttttatcatagcaaacatcgtcattatgtttccacagcttccattcacgcgtctgttttccatcttgcataacgattatgtttcttaagttaacgggagccacatctgctaaatagctttccatttttccaaatagggctgaaacactttttgtcccctgtagaggagccatggctgatatttttttgttgtcgtaatctacttcaatgacattgtccttcaaacgcatatgtatagaaacatttagccatttttctcgttcgatatgagtgtctatggtaacaatgccctcattgagtactaaagcgggaaaatgtctttcttcgcctgccacaaataaaaaacgaatatattgattggtatttgtatataaatggagaatggaaccgaaatccggttcattggcacgaatatacatttgaaaggaaattgtgaaatcattttttatagggaaaggttgattgtcatccagaaataaagaggttctctctattgctgatacagtatgagacttgagatgaagtccataatcatatagggaagatgcgtccaatttgcctaccaggcagagcaagacaaaaatcaatatttgtagttgatatttcatagtacttctacttctgtcagttttgcaattaaatattgcaaaaatacaaaaaactgtatgatatccctaagaaataggggatatctttaataaaacatgaaaatgtctcaaaatagaaaattcatttctaagattctattttgagacattttagatgaccggataacgtttatttataatttgctgacggaggagcggcattcattccgtttccccatgttttattgggtttgttgcccattatcagcatcaacttgcctccatttttcagatcgtcatggctgaaccagggtttattccattcctgaccgtttagggtggcagattgaatatatttgttttcgtcggaagcattttgggcgtcgatttcaaatatagagccgttatcaagggtaatctttgtatttgtgaaaagcgggctgccgatgttgtagacaggtaatcccggagtaacaggataaaaacctagagaggagaagactacaaatgaggtcatgccaccaccatcttcatcacccggcatacccattaggtcgttacggaaccaagttttcagcatttggcggatacgtttctgggttttccaaggttgaccggcatagttgtatagataaggtatatgtaaagatggttcgttagccatggaaaattgtccgacattgccggtatgatccggtaattgtgcgtaaaattcatatttcccgcgtcccaatggttcactgaaggtacgatcgaggttggcgatgaatcgttcgtttccgcccatgagactgattagatcagccacgttatggggtacatcccaacgataaacccaaccgttgttttctccataatattcacgggctcccataccaccggagtaacggtaatcgaatggttcaatccagttaccttccttatctttcgggtgaaagaaaccggttgcttcattaaaaatattccggtaattgtaagagcattgtaaatagtgcgcagcttcatcttttttacctagtgtttctgctatgcgggagagacaccattggtcatagctggttcccaaagtgacagccacaggctggcgtttttcgaaaggatgcacattcggatcattctctttttcacccgggcggagagcagggatatatccgttttcccggtagaagttatccaaccaaccagctgctgctcctgaccagggagcaagagttttttcttctattcctttctggcaggcttcgtaagcttttgcagcatctacttttagtccttttgtcaaagcatcggcgatagtagctacggcatgattggaattcatgcgtcgtgtgtctcctgttacttcggggaaagtaggcatccacatgttgcccatctgttcggccattcgtaaatatgaagctataatatcttcttcttttttccgatcgattagtgtacggagcggatgtgcggcgcggtaagtgtcccagatccagtcatcggtataaaaggggatgccgttgtcgttatgtacttttccatcaaaagcgctgaaataaagaccaccgtcttcactcatacagataggacgttcgaaagtacgatagaacgaagagtataatacggtcttgtcattttcagtacctccttctactttgatgcgtcctaaggcttcgttccatatccggcgtcctgtttctgccagcttatttatgtcataatcccctaattcactacgcaggttcttttctgcttgttcttcactgatgaaagatatgccatagcggaggtttattgttgtcgttccgtcggcaaaacgccatgccgcacaagcattggtgccattggcattatctttgctggcttcgataacgccattttctagaacgccggtgctcactggtttttcttgtggctcgatgtatacatagacattggtattatcacttaactgttgatgaccgctgatgaagttttcgcctacatggatagagccattgcgggaattgataatgatgtaaacgggtttatctgcttcaaatgttatccggtaaagggcggagcgatgcgaaagggcatattctgctttcatacggttatcatccagctccacttcgtacgagtatggggtaagatgttcgttgtcataattgtaggcaatgatcggatttaaattagtcccttgataaggactaaggttgaatgcggaacgttctctgtgattagtgacaataatagggagcccgttcagtagttcggtagtgtagtcggcacgttcgggatagacacgaagcatgctgttaggcaattgaatggtagggaatgtgggaacgagcagatgactgatattccctatgtatggattaacatagtcaaccggatcccggttgactatatattgtcctccattgcatgcccctaacaaggaggagattgccatcgtagctaaaaaatgtattattttcatgatatgttttttgttttaaatcgttttctattcctttatcattttgtttccgggttgataaaagcagcttttagtaatggaagaaaatcttttttgttgtcacatttgaagaagccgctgaagtcgttccggtcttcagctcctattttaataactagtttgttccaaccttgtaataggggtaactctttgtatatgatttcgttttgcccgttgtgagacacactgttgtaaggcttgttgttgatgaatagctcgcgtttctttgcctttaacatcaaagagagttttggcatgttcggctctattagcaagtcatctagcggacgtggactgaatacatggaattctaacacccaactatcaccgtctttcgttagcttctcattggcagttaccggaaaattcacttgttcgtcacgtaagaaaaatacttcattgatgttgatttccggtttaatgtaagtaattcctgcattttttaagatagcgcttagagtgttatatcctttctctgagttagcaaattcggttaatgtgttcagatagaaagtagaaggaccgtgctgatatttaacaaacacaggagtggcagcagtgcattcgtattcgctgcgaattgttccggcagttttgatttcctccggacgtttgttccattgacgccagtcggttttgcaggcgtttaacaagacttcgccttcttctacaagtgttcctttcagtgagtagtcacaagcatctgctttttgaagttcgcagaaatagaagtctgaattattcaggccacgcatccatgatttctgtataggaaggaatgatgagcgtttcaatctatctaaggttactggaagaggcagaatttcattatattcatttatggtttccggtacaagtccccatagccagatatccgctcctttgagcaaatgtttttgtatttcttttcgggtattggcacttaatgcctgacttgcgtctataatataaagcagtgaggcgggagtggtaatctttgaagtgaagactactccttgggcatccaaaagttgttttattttgccggtaggatttcctatgaatacaacttctttataattctcaatcatgctttcggatttaatggcttcgtactgcgttttgttgattacagcataaggcgaccaagcaggttctcccggagcatttgcggcacgtaatgcactgtacatcggccattcttgatagagtggcagagtcgggtcatagccaggattgaatgtagtgctatagggacctatacgttcaggttgtacgcccggaattccctcacgatattcgctgaagaaaattccgtcttcattgacagacggggctgtagaacaatcttttttaccgagtggtaatggtttcaatgcataccatgccatattgaaaacagtactgtatgaggctcccaatcggcgttggttggctatgaggttgtaacattcgttagccagtccctccatgcgtccttcttgtgattcataggcacgttccccgttatatttggatacttgttcaggtgtgccgtaataagccatactgtgttcgccgataccccaaggttttccaatactaatccagtttttcatggaattggtatctccataatgtcctactgttactggtaatatgccattaccgtcatcttctccgtcagaagaaatccaagggcgggtagggtcatactggcgtacaatgtcgcgccattcctcccatgctttttgttgggctggtattaattcgggacggttgtacacatgtaggataacgggtttgttttcgttgctgatactccaaccaaaaacagaagcatggttacggtcacgtagaacaaagcgctttaaatgttctttcgattctttccaaaagtgttcggaatcgagtttggggccaccgtcactagcccagttggctgtttcatttagtacacagatacccatctcgtcagccatatccaagtaaaagcgaggatagacttgagcatgcggacgtaccgcatttccgttcattccttttatggctgtaaaccaagcccatgcatagcggcgtgtcatttgcgggattcccatgaaatgccaggagtctccatgtaaagcgtaaggttcaccatttaagcattgtgtggttccttgtaatgtccattcacgccagccaaaacgttcatattttgtatcaatagtcttttttttgtcttgtatagaaagtaacagagcatatagattgggagattcgggcgtccagtattttaatgtgttttcatttacaggtatttgtaatgttactttctgtgatgcgttggcgtcaatagatactttatgaggagttacatataaggcttccataccaagtgaccaagtaggaactggtgcggaattaatatcggttccggcacagtttatccattcacggatattaccttgcagttgtatatctgttttcttggccgttttattttgtacggttacttctacttccagtgtgttttttgaaactaatggttttacatatatgtcttctatatgtactttggggagagccaacagatacacatcctgccagatgccgttgatatgatacccccacatggaacctgccgggatgatacgtcgtccgatcgtcgaattattttcaaacagggactggctgcgtacacctatcagtatctcgacagtttcaccgggagtgactttatcagtgatatcgaaactgaaaggcaggaataaatcaaaattttcacctagtttttccttatttatgtagacctcggagtaccctgctactgcttcaaaatagagttttatttgttggcttttccaagtatcgggaatagtgatattttttttcatccatgccattttcacttgttcccattctttggggtaagaagggtaattgcgatgatcagggccttctaagttacggtagccgaaagaattgatgttccatggcgaagggattttaattcgtgttttgtcccagttttcgtctttagggaaaggaagtttgggagctattcctttgccttgcttataatcctgtggtaaagcgacaggctgaaaatcccaatatccattcaggcaaatttcctgacgatgctctttctctgttttattcactaagccttcgctgggagcaaaagtataagggtaggtcattttctgaccgttggctgccgtttgtgcacctgtttttgtaggctgcagagtaaaactggctagcagactgcataataaaatgaaatttttcttcatatcttatgttttaataagttttccctgtattatcggatggcaaagtaaaaggaaaagtattaaaaagaggaagtgaaagagcttaatatgagattaaaaactgattaataggtatgataacttgtaaaaaagatcctttttctctgatttaatcgttttttaatttccgattaattctaatcaaccggttggattaagaggtgcaaggtatctttgtgtctataaaatatgtggctggtacatattgccgccaagaatatttgagataaccaaattgaaaaataactttaaattaaaagaaaagctatgaggaataaattattatttgctctgaaatgttcccttccgttgtttattggagggatggtgttaaactcgtgtaaagatgattctcctgtttccggtttcaaagaagaggaaggtgaatatgtatacgattatgacagatatgaagatggtatgagtgctgaagaatttttggctaattatcaaggaataccatttaaaaaagatcaggaaggaaatagtttgttaattatttccggtgagcctgctactgtggaggcggaagattttgatgatggcggggagggagtgtcattccattttcaaaatgcaggatatggtggatatgattatcgtgaagaaaaaggagttgctgtcagtaaaagcggtgatgtcgttaatatcggcaacgtgagcagcgacgactggctttgctacacattacaagtgactgaggcgggagcttattctattgatacttattgcgtaacagccaatgggaaaatcagcttttattttgaaatcgatggtagggctgccggccagattgtagaagctccggaagatgactggaatgtatttacacattcggtaaaggtgacagatgtacagttgagtgaagggaaacacgtattaaaatggtttactacaggtggcatcaatctggataaatttgtaataacacgcaccggggaatataccggagagcagataggaaattctttgtttacctatccgcgttatggcacttatgaacataatccgttgtttgtggattttaaatcggaaatgtataatactccatttgtaggaacgctttatacagctgacccttctgcgcatgtttgggatgatggacgtttatacgtttatgcttcacatgatatggagccaccggtagggtgtgaccgcatggatcgttatcatgtgttttccactacggatatgaagaattggacagatcacggcgaaattatgaattcagccactgtaaaggcacagacaggcttgggtattgacggctttatgtgggctcccgactgtgtatataataaagaagaacagttatactatctttattttcctcatatgattgatgaagctacatggcgaatctttgtggcgaccagtagggaaccggctgcaaaattcagagtgaaaggtgttattgaagggattccttcaacaattgacccttgtgtgtttgttgatgatgacggacaaccttatatttatacgagtggtgccggtcaaggttgttggggggggaagttgcgtaaagatgactggacaacactggatggcactatgactcctctgaaaggtttcactgattttcatgaggctccctggatgcataaatataaaggtaaatactatctgagccactcagacaatcatgcttctactcaaggggggaatcaaatgcagtattctgtatcggataatccattaggaccttttactccatgtggtgtatatatgtatccccaaggtgaagaaactgctcatggttcaattgttgagtataatggtaaatggtactctttttatcatacatccaaccattcggggagaggtggcttgcgttctgtttgtgtagatccgatcgagtatgacttgaaaggaaatttgaaagttgtgaaaaattgggggcgtccttatggtaatagggcggtagagataggattgaacaaacagacaattatacaggctgagaattataatatgggcggtcagcatactgcttattacaagaatcctaaaacaggaacgagaatggatgtgaaaacagaaaacggtataggttttctgagtagcatgaaaggaggagaatgggtacgttatacattcaatgtaagtgaggccggacgctatggcattacattcagagtgcgtcagaaacgtaatggtggaaaatttcgggtagcagtcaatggtgtatataaaaccaatgatatagttcttaatggaggcgtaaatacatggattgaatcttatgtttatcctgtagagttgcaggaaggcgaacagtatattgatatacgtataaagagcggtgatttggatattgattggataagatttggtgaaggagccagtttgattcctggcattattcaggcggaagattacgatgatggaggatactccttcaagcagggtgagtttggtaatttcaaatcttatcgaaaagataagggagtagctatcagtgctagcgatggggttgttcatattagtaatacttctgttggggattggttacaatatacatttactactcaaggaggagcatttgaaatcagagtacgtgcgtcggcagaaagagacggaattttctctctctcgtttgatgacggaaaacctttgagtaatgttgctgtttctactggtggttggactacttatcaggaattcatcggggccaaagtgaatttgacaccaggtaagcacacaatgaagattcatatcgttaatccgttgaatcttgattcatttgaatttcggtagaattgagatagatgtatcaaatttgatacatcctgaaacaaagtttatagacgaaggcaaagataccccctatctttgccttcgtcttttagattaaaagcttatataaactaggaatactttgttgccatgaaaacaaacccttggatgaaactatgtaaaggtgcaatacttgcgttagcagtctcttatggactgacttattgccacaccactaaaagcaagttgaccttggaacagaaaagcgatagcctgactgtcatccacatcactaatccgactaattatatattgcttcctatagaagaggaagcagcggaaagtcaggttctgcttgataccggagaggctacggataccgatatggatattcgtttggcacagactcaagtggactatttcgttccatttgccttgcctaccggagtgaagactgccaccgtgtgtgttcgtaataaatcaaaggatgcactttgctggaaagaaatcaaactatctgatacttttgatacagccaatacggaaaagttccgccctgtttaccatcatactcctctctatggctggatgaatgatgccaacggattggtgtataaagatggagaatatcatttgtattttcaatataatccttacggctctaaatggggaaatatgcattggggacattctgtcagcaaggaccttgtacattgggaacatttggccccagctattgcccgtgatacattgggacatatcttttccggtagctctattgtcgatcaggaaaatgtagccggttacggagcagggaatatcctggctttttatacttctgccagtgacaaaaacgggcagatccaatgtcttgcttttagcaaggataatggacggacatttactaaatatgagaagaaccccatcttgtgccctgcggatggtttgagagatttccgtgacccgaaagtgttccggtatgaaccggaagataaatgggtgatgattgtctccgccgataaagaaatgcgtttctatgactctaagaatctgaaggactggaactatatgagtagttttggagaaggatacggggtacagccttgtcaatttgaatgtccggacatggtggaacttccggtggatggagatctgaaccgtaagaaatgggcattgatagtgaacgtcaatccgggatgttatttcggaggaagtgctacccaatactttacaggaaactttgatggaacgaaattcagttgtgacagtcagccgaatgtcacgaaatggttggattggggcaaagatcactatgctaccgtttgtttctcaaacactggagaacgaacgattgctgttccttggatgagtaactggcaatattgtaatattgttccgacaaagcaattccgtagtgctaacgctttgccgcgtgagttaagtctttatacacaagacggtgaaatttatctttcagcagttccggtaccggagataaagactctgcgaaaagaaaagaaagagattccggcatttacggttgccaatgattatcatattgattctttattggctgataatgatggtgcttatgaactggcattggaaattaccgtcggagaagcggagataatgggattcaacctctttaatgataaaggggaaaaggtggatatctacttcaatcttccggaaaagagattggttatggaccggacgaaaagtggtatcgtggatttcggaaagaagagtgtatctcatgaaatagaggttcacgaccgcagaaagacgacttccatcaattatatagatgatttcgcattagctacctgggcaccgataaagaaagagaataaatatacgttggatgtctttgttgataaatgttctgtagaaatattcctgaatggaggaaaggtagcaatgactaatcttatctttccatcggaaccatacaaccgtatgtgtttttatagcaaaggaggttcatttcaagtagattcattcaaggcgtatcggttgggtttataatagaaatagaagttacacaataggtgtttacatagattcagtgaaagcaacaagtattgattgctttttaaggattcataggttagatttataagttaggttttgtagattagaattaggtgtttggtagctgtcagatgtgaaatccggcagctacttttattcatcaattattcatcaattattcatcaatttcaattgtatatcctccttggaatatctcttccggttgtaagtgctgcatccagtccttatctttatattcaccagtataatgtgcgcggtcgcaacgtccgtaccaaggttcgatgcagacgaaaggagcattctttgcaggtggagaccagagtccaactaccggagcattaaaatgtagactaagataagccagtttctctttattatataaggtaactttacggacctgttcattctccagtatcaaagcatctttatcaaaagtatgcgtgtccagtggtaataatccgtccgtcaactctaaagaatattcagtagaaggatcagcgcatcctttttctgaaatgagaatatatttcaaaccgttttccttgtcaaatctgaagaaccctctttcagaattgcttgcatcgaattctggccaatagaaagcaggatgtgcaccaatctgaaaatacatttccttgtcgccagtattctttacttcccacataacctcaattttctttccctggatgcgatagcctatttccagacagaatggaaaagggtatttatgcaaagtttcttcattgctgacaaggcggtaacgtacttcatcctctttttcagaaataagagtaaattccatgtcacgggcaaaaccatgttgagtaagcgtataaggaatcccttcattccgatactcattttcccatacgctccctacaatcgggaataggacaggagagtgtcgcttccaaaaagcaggatcggcttgccacagatattcttttccattggcgacgatgctgcagagttcagctccgtggggagatacttgaatcgtgagttgtttgttggaaattgttttcatatcgtttatttattggattattttagagttaatctttaagttcatcttgccatcaactgcctgcattttcaactggtgacaatttgtcaccgtttcatttccttcttctttaagtctctgtttcagcttattccaatatttacgtccatcggtactttcagttaaaatgctaaccacatctactatcgaaaaataccacttctcttgttcatcatcccataccgtacgtacttttttttcctcaaagagctttaatgcttgttgtttagtcatgaattctgtttttagaatctttaattggttgttatcttaatgaagagtcttctctattttggggctcatatcactacacaaagataccactttcaatctacataagagaatatgaacctcatttttctcatagcaagaagaaaacatgtataaaaccctataaaatagcgttctatgcaacaaatgttatagcctttgaaacatttttttcagtcgtttgatataaatcaaccgtaatttgcattatcgatatagataaaattcgtacttttaatttaataacatcaaactaatgcatcgtattatgaagaacaaaaaacttctttgcagcgtttgtttcctgtttactttcatgtcagtcctttgggggcaaagcattacggtgaaaggaaacgttacttctaaaacggacggacagccggtcatcggcgcctctgttgttgaagctacagctactgctaatggaacaattactgatttagatggtaatttcaccctttcggttccggctaactctactttaaagattacgtatattggttataaaccggtgaccgtaaaatcggctgctatcgttaatgtattattggaagaagacactcaaatggtagatgaagtggttgtaacaggttataccactcaacgtaaagctgacctgaccggtgctgtttccgtagtgaaagtagacgaaatccagaagcaaggggagaacaacccggtgaaagcacttcaaggccgcgtgcccggtatgaacattacagcggatggaaatccgagcggatcggctaccgtacgtattcgcggtatcggtacgctgaacaacaacgatcctctttatattatcgatggagttcctaccaaagctggtatgcacgaattgaacggaaacgacattgaatccattcaagtactgaaagatgctgcttcagcatccatctacggttcgcgtgctgcaaatggcgttatcgtcattactaccaaacaaggaaagaaaggccagattaaaatcaactttgatgcttcggtttcagcttccatgtatcaaagtaagatggatgtgttgaatacggaacagtacggacgtgccatgtggcaagcctatgtaaacgatggcgagaacccgaatggtaatgctttgggatataactataattggggctacaatgccaacggaaatccggtactatacggtatgagtctttccaaatacctggactcgaagaatacaatgcctgtggcagataccgactggtttgatgaaattacccgtacaggtgtcatccagcaatacaatctttctgtcagcaacggttcggagaaaggttcttccttcttctctctgggatattacaaaaacctgggtgtaatcaaagatacagacttcgaccgtttctccgcccgtatgaacagcgattataaattaattgatgatatattgactatcggccagcatttcaccttaaaccgtacttcggaagtacaagctcccggcggaattattgaaactgctttggacattccttccgctatccccgtttatgcttcggatggttcatggggaggaccggtaggcggatggccggaccgtcgtaatcctcgcgcggtactcgaatacaacaaagacaaccgatacacttactggcgtatgttcggtgatgcttatgtgaatctaagcctcttcaaaggattcaatgttcgttctacttttggtctggactacgcaaacaaacaagcccgttacttcacctatccttatcaggaaggaacacagaccaacaacggcaagagtgcagtggaagccaaacaggaacactggaccaaatggatgtggaatgccattgccacttaccagttggaaataggcaaacatcgtggagacgttatggcaggtatggagctgaaccgggaagacgacagtcatttctccggctataaagaagatttctctatccttactcccgactatatgtggcccgatgcaggtagcggcacagcacaggcttacggtgccggtgagggttactcgcttgtctctttcttcggcaaaatgaactattcttatgctgacaaatatctgctttcattgacgctccgtcgtgacggttcttcccgcttcggtaaaaaccatcgttatgccactttcccttccgtttctttgggatggcgcatcacacaggagagctttatgaaggaactgacttggttggacgatctgaaactgcgtgcttcatggggacagaccggtaatcaggaaatctccaaccttgcccgttacactatctacgctcctaattatggaacaacagattcatttggcggtcaaagctacggtacggcatacgatattacaggttctaacggaggtggtactctgccttccggattcaaacgtaaccagattggtaatgacaatatcaagtgggagacaaccacacagacaaacgttggtatcgacttcagcctgttcaagcaatccctgtatggttcattggaatactattacaagaaaaccaccgatatcctgactgaaatggcaggtgtgggagtattgggagaaggtggcaaccgttggattaattcgggcgcaatgaaaaaccagggttttgaattcaacttgggctaccgcaacaagactgccttcggactgacttacgacctgaacggaaacatctccacttaccggaatgaaattcttgaactgccggagacagtggctgccaatggaaagtttggtggtaatggagtaaaaagtgtagtcggtcatacatacaactcacaagtgggctacattgccgacggtatcttcaaatcacaagaagaagtggacaatcacgctacgcaggaaggtgcagccgtaggccgcatccgctaccgcgacatcgaccataacggtgtgattgatgaaaaagaccaggaatggatttacgatccgactcctgctttcagctacggattgaatatctacctggaatataagaacttcgacctgactatgttctggcaaggcgttcaaggagtagatatcattagtgacgtgaagaagaaaagtgacttctggagtgcatccaatgtcggcttcctgaacaaaggaacccgcctgctcaatgcctggtcgcctactaatccgaactctacgattccggcattgacccgcagcgatacaaacaatgaacagcgtgtttccacttactttgttgaaaacggttccttcctgaaactgcgtaatatccaattaggctatacagttccggcagtaatctccaagaagttgagaatggaacgtttacgtttctattgcagcgcacaaaatctgctgacgatcaagagtaaagactttacgggagaagaccccgaaaacccgaacttctcttatccgatccctgtgaatatcaccttcggacttaacatcggattttaattcacttcatttataaaacgaactatcatgaaaaagatactatacatagcaaccatcggatttaccttgctgacaagcagttgcaacgattttctggatcgtcaggttccgcagggtattgtgaccggcgatcagatcgcttctcccgaatacgtggacaacctcgtgatttcagcctacgccatttgggcaacaggtgacgacatcaactcttccttctcgctttggaattatgacgtgcgttccgacgattgttataagggcggttccggtacggaagacggcggtgtgttcaacgcactggagatttctaaaggtatcaacactaccgactggaacatcaacgatatatggaaaagactgtatcaatgcatcacccgtgccaacacggccttgcaatcactcgacctgatggatgaaaagacttatccgttgaagaaccagcgcattgctgaaatgagattcctgcgcggacacgcccacttcatgctgaaggaactgtttaagaagatcgtcatagtgaacgatgaaaacatggacccggatgcttacaacgagctttcgaatactacctataccaataacgaacaatggcaaaagatagcagacgacttccagtttgcctacgacaatctgccggaagtgcagatagaaaaaggacgtcccacacaagctgccgctgccgcttacctggcaaagacttacctgtttaaagcctaccgtcaggatggagtgaacaacaaccttaccggtatcaacgaagaagacctaaagcaggtagtgaaatataccgatcctctcatcatggccaaagctggttacggattggaaaatgattatagcatgaacttcctgcctcaatatgaaaatggcgcagagtctgtatgggcgattcaatattctatcaacgacggaacatacaacggtaacctgaactggggaatgggactgacaactccgcagatactaggctgctgtgacttccacaaaccgagccaaaatctggtgaatgctttcaaaaccgactcgcagggaaaaccgttgttcaatacctacgataatgagaactacgaggttacgacggacaatgtagacccccgtttattccacacggtaggtatgccgggcttcccttataaatataacgaaggctacctgattcagaagaatgatgactggagccgtagcaagggactttacggatattatgtttcgctcaaagagaatgtagacccggactgtgactgcctgaagaaaggttcttattgggcaagttccctgaatcatatcgtcatccgttatgcagacgtattgctgatgcgtgccgaagccctgatacagttgaacgacggacgcattgccgatgccatctcacttatcaacgatgtacgcagccgtgcagccggaagtacaatgctgatcttcaattacaaagaagagtacggagtaaacttcaaagtaaccccttatgaactgaaagcatatacacaggacgaagccatgaaaatgctgaaatgggaacgccgtatagagttcggtatggaaagctcacgtttctttgacctcgtaagatggggagaagccaaagacgttatcaatgcttattatgtgaccgaagcagcccgttgttctatttacaagaatgcaggttttacggaaaataagaacgaataccttccaattccattcgaacagatcagtgccagtaacggaaattatacacagaatttcggttggtaaccatcaatcttaaaacaaagaataaaatgaaatcaatcataaaacaactctataccatcctgttggtgactgtagcatgtctgacagttgcgggatgtagcgatgacttcaaatccaatcttcgtctggacggagatgtatgggtgaactctatcaaactggatgaatacgcagggacgatcgattatcagaataagacaatcgtagtgggagttccttacgattatgacgttacccggatggccgtcagtgaaatcaatctttccgaaggtgctacggcgagcatcgctgtcggtgaaacaatcgacttttctcttcccgtatctttgaccgtgaagaatggcgacgtacagatgagctatacgattaccgtgaagagagacgaagcaaagatactgacctttaagttgaatgatacgtatgtcggaaaagtagaccagctatcaaaaacaatctctgtagttgttccgctgacagtggatattacccagttgaaaggtacattcaccggatcagatggagttactgtgactccggcatccggcagcatccaggactttaccaaccctgtcacttatacggcaacttaccgttcggcagtgactccttatgtagtaacagttactcaaggaaatgtaattccgactgcctttatcggcacagcttcttctgtgagccaactgacaagtcctgaagaaaaagccgctgcccagtggatgatggataatatatccatgtccgaatacatctcattcaaagatgtagtagacggaaaagtagatttaggtaaatatactgcaatctggtggcatttccatgcagacaatggcgataatcctcctttgccggatgatgcgaaagctgccatagagaaatttaaagtctactatcaaaacggtggtaacctgttgctgacccgctatgcaactttctatattaaggaccttagcattgcaaaagacgagcgtgtacccaacaacagttggggaagaagtgaagactcacccgaagtcgttgatggggcatggagctttccaattgtcggcaacgagtcgcatccgttatttcaggatttaagatggaaagatggtgacaaaacaagagtctatacctttgatgctggttacgcgactaccaatagtacggcacaatggcatatcggaacagactggggaggttatgaggatctgaacgcatggcgtagcttgacaggaggaatcgatgtggcatgcggagacgacggtgcagtaatcattgccgaattcgagccgcgcgccaacagcggacgcacaatttgtatcggctccggttgttacgactggtacggtaaaggcgtagacacttctgtcgactactaccactacaacgtagagcaaatgactctgaatgcaatcaactacttatgtaaataaaagaataagcaataattatgaaaaatatgatcttacatatagcaatcaccacgctgttggcctcaatgagcgcttgcagtgatgagatggattccgtattgactcaaagagactgggacggtacagccacttacttccaatcggccgacgagcatggcttctcgatgtactataaaccgcaggtaggctttgtcggtgacccgatgccattctatgatccggttgccaaagactttaaagtgatgtacctgcaagattaccgtccgaaccccgaagctacttaccaccccattttcggggtggccaccaaagatggtgctacttatgaatctctcggcgaactgattccgtgtggaggtcgtgacgaacaggatgccgccatcggtacaggaggtaccatctataatccggttgataaactctactacaccttctacaccggcaataaattcaaaccttcttccgaccagaatgcacaggtagtcatggtggctacctctcccgactttaaaacatggaccaagaaccgcactttctatctgaaaggagatacgtacggctatgacaagaatgacttccgcgacccgttcctgttccagaccgaagacggcgtttatcacatgctgattgccacccgtaaaaacggaaaaggacacattgccgaattcacctctactgacctgaaagagtgggcgtctgccggcacatttatgaccatgatgtgggaccgtttctacgaatgtccggacgtattcaagatgggagactggtggtatctggtctattcggaacaagcttccttcatgcgcaaggtacaatacttcaaaggcagaacacttgaagaactgaaagcaaccaccgccaatgatgccggaatatggccggacaatcgggaaggtatgctggacagccgtgcattctatgcaggcaagactgcttccgatggaaccaaccgttacatctggggctggtgtcctacccgtgccggcaatgataatggaaacgtaggggatgtagaacccgaatgggctggcaacttggtggcacaacgcctcattcagcacgaagacggtacgttaacccttggagttcccgatgcaatcgaccgtaaatacacttctgcacaagaggtaaaagtgatggctaaagacggaaacgtaacagaaagcggtaaaacctatacgttggccgaaggagcttccgttatcttcaaccggttgaaagtacacaacaagatttcctttaccgtaaaagcatcctcgaatacagatcgttttggaatctctttcgtccgtggaacggactccaaatcatggtatagcatccacgtcaacgctgacgagggtaaagccaacttcgagaaagacggtgacaatgccaaatacttgtttgataacaaattcaatatcccggcggataatgaataccgtgtgacgatttacagtgaccagtcggtttgtgtgacttacatcaacgaccagttatctttcacgaaccgcatctatcaaatgcagaagaatccgtgggcactctgctgttataaaggcgaaatcactgtatcagatattcaagtgagcacctattaatagaaaagtaacatcttttacagtgtttgaaacaaaagtgataggcgtttcatcccggagcgcctatctttgcactgtaacaaccttaataccataaagcatgaatttaagactctcttccaaacaaattcaaaccttcgcggttttattttgtatgattgtgatgaatatctctctatccgcccgtgcggataactctcctctattaattaaagatttaggagaaggacattgcctcgtacgtgtcaacactaaccagaagtatctgttgttgcccgtagaagatgcatcgcccgatgtgcgtatcagcatgattattaataataaagaggtaaagaacttcgatgtccgtctggccatccataaagtcgattactttgttccggtagacctttccgactattccggcaaactaatctctttcaaatttaaaatgaactccaacgacccggttcgtgtcaacctttcgccggacaacaccgcttgctgcaaggaaatgaaattgtccgatacgttcgatacaagcaaccgtgaaaagttccgtcccacctatcacttttctcccctctacggatggatgaacgacccgaacggaatggtatacaaagacggcgaataccaccttttctaccaatataacccttacggctccaaatggggaaatatgaactggggacatgccataagcaaagacctcgtaaactgggaacatcgccccgtagcaatcgccccggatgcattcggtactatcttcagtggctccgctgtgatagatcatcataataccgccggcttcggtgcaggcgccatcgtcgccatctatacacaaaacggcgaccgtcaggtgcaaagcattgcttacagcaccgacaacggacgtacctttaccaaatacgaaaacaatcctgtattagtatccgaagcacgtgacttccgcgacccgaaagtattctggtacgaaggcaccaaacgctggatcatggtattggcagtagggcaggaaatgcaattcttctcttcccccaacctgaaagactggacatttgaaagcagcttcggcaaaggacacggcgcacacggaaacgtttgggaatgtcccgacttattcgaactcccggtagaaggaacaaatgaaaagaaatgggtacttctttgcagcctcggcgacggtcctttcggtgactcggccactcaatattttgtaggctccttcaacggaaaagagtttgtaaacgaatcaccctccaaaaccaaatggatggactggggaaaagaccattatgccaccgtgacttggagtgatgctcccgacaaccgccgcatcgctatcgcatggatgagcaactggcaatatgcaaacgatgttcctacctcccaataccgtagtccgaactccgttccccgcgacttgggcctgtttaccgtagatggtgagacttacctccaatcagctccctctcccgaactgctggctttgcgcgatgcttccaagaaacgttcgttcaaagtaaacggaacacgcacaatcaaagaaatgattcccggcaatgacggtgcatacgaaatagaactgacgattgaaaatcaacatgcagacgtaatcggcttccgtctctacaatgacaaaggcgaagaagtggatatgcagtatgacatgaaagaaaagaaattctcgatggatcgtcgcaagagcggagaggtcagcttcaatgagaatttcccgatgttgacctggacagccattgaaagtggaaaagacgaattgaaactccgtctgtttgttgacaaatccagtgtggaagcctttggtgatggcggacgttttgtgatgactaatcaagtattcccgtcggaaccttacactcatatcgacttttacagtaaaggaggagcgtataaagtagattcgtttgtgatctacaagttgaagaaataagctcattctcctaactccatgcgctctttccctgtttctttagagtaaaaacttctttccctatagactaatacttctttccttatggaagagtacgtctgtcctagtggaagagttctattaaagtgcggagacactttcttcaaagccacggttctgttggttcgtcacggccgtgacgagatcctcccacggccgtggtgagaactcttcacagccgtgggaagaagctaccacggccgtggtaacccaacaataccgtagctttaaagtaacaaggaacgggagatacaccaactatataaaggactgatgcatacattgccgtaggattatgtgctccgccctatggaaacagaattcatcatataaaagataaaataatggaaaatagtaaaaactcttccctctccaaactaatcccggtgatgctttgcttcttcgccatgggattcgttgacctggtaggcattgcctccaattacgtaaaggcagaccttgggctgtcggactcacaggcgaatatctttccgtcactggtattcttctggttcctgattttctccgtacccaccggcatgctgatgagccgcattggtcagaagaaaaccgtattgcttagtttgattgtgactttcgcttctctgttgctacccgttttcggcgacagctatatgctgatgttgatttccttctccctcctgggcattggaaatgcgttgatgcagacttctctgaatccgttactttccaatatcgtgcgtggcgaccgcttggcgagtagcctgactttcggccagtttgtgaaagccattgcttctttcctggcaccttatatcgccatgtggggagcgacacaggccattccgactttcgatttaggctggcgcatcctgttccctatttatatgattgtggccgtcatcgctattcttctgctcaatgtcacacagattgaagaggagaaagaagatggcaaaccgtctactttcggacaatgcatcgccctgcttggtaaaccgtttatcctgctttgttttattggtatcatgtgtcatgtcggcattgacgtaggtacgaacactaccgccccgaagattctgatggagcgcatcggtatgggattggatgatgctgcttttgcaaccagtctttattttattttccgtacggcgggctgttttctgggttctttcatcttgcgtaagatgtctccgaaatctttcttcggcattagtgtggtgctgatgttgattgccatgatcggtttgtttatcttccatgaaaaggcaattatctatgcctgcatcgccttaattggtttcggtaactccaatgtgttttccgttatcttctcgcaggcattgctttatctgccgggtaagaaaaacgaagtttccggcttgatgattatgggacttttcggcgggacggtgtttccgttggcaatgggagtagcttcggatacttccatgggacagaatggtgctatcgccgtaatgacggtgggcgtgctttatctcttgtattatacgttccgtatcagaaaataattttataactttggaaacaataaaacccgtatatcatgaataatataattgtaggaatgggcgaagcactttgggatgtgttgcccgaaggaaagaaaatcggtggtgctccggcaaactttgcctatcatgtatcacagtttggttttgacagtcgtgtagtgagtgccgtaggcagggatgaactgggagaagaaattctgaaagtattcaacgagaagaagttgaagatgcagattgaacaggttgattatcctaccggtacggtgcaggtgacgctcgatgacgagggcgtgccttgttacgaaatcaaagagggcgtggcgtgggacaacattccctttacggatgagctgaaacgtctggccttgagcacacgtgctgtttgcttcggttcgctggctcaacgtaatgaagtgagccgtgccactatcaatcgctttctggatacgatgcccgatatagacggacagctcaagatatttgatatcaatctccgccaggatttctactctaaagaggtactgcgcgaatcgttccaccgttgcaacgtcctgaagataaacgacgaagagctggtgactatcagccgtatgtttggttatcccggcattgatttgcaggataaatgctggattctgttggcaaaatacaacctgaagatgttgattctcacttgcggcatcaatggcagctatgtgttcacaccgggcgttgtctctttccaggagacgcccaaagtaccggttgccgacacagtgggcgcaggcgattcttttacagctgctttctgtgcctccattctcaatggaaaaccggtgcccgaagcgcataaactggctgttgaggtttctgcttatgtctgcacacagagaggtgcgatgcccgaacttccgcaggttttgaaagatagactgatgtaattcttttattgatagtaagcatagaggtatatttcatttcgtggggtgtacctcttgtttttgtacgtacgaaacgtacaggcataaaaaaaggagcaacgccttgctccaacctttgttaaccttaaatctaatactatgaaaaacacattgcaaagatacggacttctgtcaactttgcaaataatccaaataaaaagagatgttttataacatcaattaagtgttcgtattaccctttatacgtttgttaatggttcccgcgtaaatatgggggaccatttttactttttttcaagggataagattgcgaataatcgagtgatttatagcatactcacagttttattttctatttttgttctcaatcaatctatcgaatactatgaacacaatgctatgccagctaaagagcctgttgttattgggagtcctgctttttgccaatggagcattcggacaaccgatgatctgggatgatacctctcccgaaacgatcgttttcgaactgactaacaaagaggctttgaaacttctcaaaggcaaactccgacagaaacaatgggataaaatacagcagactccttttgcccgtttcacggatacttggagcaatcctccggtcaaagggcattttctgctggctgatgtagagcggaacgaagttcattaccgttatgctccggtgattccttttcatgttttccttttcaaggagtatggtgtactcaccttgcaggtggttgatgccgggggaactatcaggaaagatgccgaagtgcgggtaggcagcaaggctgtttattacgatgaagacagtcagacgtatactgacgataactggtcgcagaaagaacagcatatcctgacggttgaagtggataagtttcgtgcggtattcgatttgaggaaacaccttgtaccaccctggtataaaaatgattatgggcggcaagatgcaccggagttttatagttacctgattactgataagaataaatacagaccgggcgaaactgtccgtttcaagtcttatgctctctccgaacataaacgtcctctgaaacaggaactttcattgtggatgcgtgtcggttcttccttgcgtgactataagaagataatgtccgtcgtcccttaccatccgggaggcttcgccggagaattcctgttggcggattcattgaacctgaagctcgatcagagatatactgtacagcttcgtgataagcggggacgcatcgtagcctccaccaatttcaaatatgaagactacgaactgaacggaaacaagttgttggtgaagctggcttcgaatgtgcaatatgcatcgcagagtaaccgcatggttatcagtgcaacggatgccaacggacttcctttgcgggaggtgaatgtagaagtgactgtcggcagacagcaggtactgaagtcgtatgcgcagatactttctttgcccgatacactgatgtccgtgcaggcggaactggatgcttccgggaaagcttcggtagatattcctgctcggatattcggagcttccgattgcttctatacggtgaatgtagttttgcttacggcagacaataaccgtttggagcagcagagcaaagcgactttctactattcgtgctatgatatgcagtgcactacgcaggcggatactatttgcttttcattcttcgacctgggagtggagtgtcctgtggcggccgaactgacctatggtgaaaagaaagaagtgaagaaagtgcgtttgccctatcgcgaaccgttcaatcaggcggtgacggactatcgtttcaaaataccggaaacaggatatgaaacgacgattgcttccgccgcacttgactccaaactggaactgaatggcggcatagaaaaagattcgttctgtgtctccctttccaatcctttgcagctggaactttcctggtatgtgtatcaaggcaaccgcctgttgcagaaaggttcgggaaaagagatggaacacaaatccggagagatcgatccctcttccgtctattacgtagaagtattttatttcatgggggataaggaatgtatgttgaaacgctcgtacacttcaccttccgaacggctggtgattgaatctgatttgccggaacgagtgtatcccggtcagaaagtgaaaacaaaattgaacgtgaccaatatacaagggcgtccggtatccaacgtcgatctgacagcttttgcggtcaacacgcagctggattatcacgtacccgatttaccctattacgggagtgcaccccgtccgcgcgagcaacgtgcttcctactcaatgaagcaaaaagagtatctacataccggcacattggattatcagcattggaaccagttgcttcatttggataagttgccttattatcagtttgcttatccttcgggaaatctgttccgtcagacggttgatacaccggatggaaccacccagtttgctccttatgtgatgctgaacgggcgggcggtgaatatctatgtgattgagcagaacgatgttccctgctatttttcgtggacggaacagcctaagcagtattcttttcctgtattgcatccgtcgggaaagcagaagataatgttgcgaatgcacgacagggctttcatcattgattctctggctttcgaccggggcaagaaaacgattttaagtttcgatatgaatcagttgccgcaaggagtggaagtagtctggttgcggcagaggaaagggaaatatgatgagtataagtttacttcggaagagaagaagcgttatgaacggtatctttgccgtcttccggtgatggatggggcggtatatacttcgctcgaacataatggaaagctgtttccggtttcactcatggagctgtcgcgctacaagaaaaagatattggcaggtcctgtggagccgggaccttggaaatatatgaatggtgtgttgtatcggcatgagggaggtttctcttatgaattcgagggcaatgtggtttataaatataaggatgaggaactgtgcccggcttatctgaatttttcgtctgtggcaaagattccgactttgaatgattaccatttatcaccggaaagattccgtagtctggtggccgaacttcgcaagggaaagagttggcatcccacccggatttatttctccctgccggataagacgttgaatttccggcttccggaagaaaaagattctaccggagtggctaacttgctctttaaagactgcactaccggagaactggtttatccggatactttggtgcaaatgaatagaatatattccaagtttcctgccggaacgtatgatgcgattttgctttataacaatggaaagtatctgaaacaggatgctctgacgatacaatcatatacctatctggatgtagatatggaatctctgcctctacacgaacgcgattcgttgtcagcagggtggctcttgctgggaagaggaattggcaggatcggtacaaactttcctggtcacagggaaatgaggatcaggcagtatgtacgcaattacggcggtaaagtctccggttatgtaacggatgctaccggagagcctttaatcgggtgcagcgtggtggtgaaaggaacgacggagggaacgatcaccgacatggacggatatttcgaaatggattgtgacaggggaggggatcagcttttgtttagttatgtcggctttaaacagcaggagatgagagcaactcccggagccaatctgttggttactttggaagaagatagtcaggcgctggaggaagtggtcgttgtaggatacggcatgcgttcaagatcttcgttgacggggtctgttgccggattaatggtaggttcttcttctgctgctgcaaccgcacctttggagaaactggaagagcaagatcagaaagcgaaagaagaagcggataacgaacagttgtataatgaactgatgcaattgaatggcttacgtaggaatttttcggatgtggctttctggcagcctcgtttgtttacggataaaaccggaacggtacagtttgaaacaactttccccgataatgtgacgaaatgggaaactgtcgtttatggcatgaaccgtcgtttgcagacgggtactttccgacgtttcgtccgctcttacaaaccgttgatggcggagttgaaaactccccgcttcttggtggagggggatcagagtacggtggtcgggactatccgcaattatctggatgggcagcacatagccggaaagacacagttctgcgtcggaacggatacgttgaaacggcaggaagtgagtttcatggagggatttcatgaaacagtgccgatgcaggcagttcatgccgatagcgtgaccatcagctatcttttcactcgcgacgatggctatcaggatggagaggaatatacgattccgatactggcacagggaactgaattggcggagggcacattgggtattctgtccgatgcaaagacggttaaagtgcaatccggcgaggatgaagaagtgatggtgagtatcactgacaatcagttggacatctataaagaatcagtgaattacttgacaggatacaaatatttgtgcaatgagcagctggcatccaagttaatcggtttgttggcttaccaacagtatatgcagagtaagggtgaaaaggtgaaagtagataaagcaattcgacctatcatccatcgactgacgaatcatcagaacaaacatcagttatggtcgtggtgggggaactctgaaaatacttctttctggatgtctgcgcatattctgcgggctttgaagatggcgcaagatgcaggttatcctgtggagttgaatctgaatggtttgaaagtggagtatgctcatacgcgtccttatcgaggaatgaaactggaagatatagaaatacttcatgctctgcatgagtggaaagtagaggcggattattcttcggcagtcagattattggaacctttcgtccggcaattggaacagaaagaagactcgttggcaaatagaaacaagtattatcgtcctctttcatacttgaaagagaagctgcttctctgggaaatcaagcaacaggtggattcggtgaatgtgggtgatagcgtacgtccttatctgaaaaaggatatgctggaaggtgtttactgtgacgacggacggcgtacttattattgggagggaaatcagatgataaatacattgatagcctaccggattattaaaaatgacccttccctgtgtaagttgaaagaaaatatgcaattgtatattttgcggactaaggagcgcggatggaatacgtatcaggcttcttcggctgtggcaactgttctgaccgatttgctggcaggttccggagggatgtcaggaacgtcggtgtctgtgagcggtaaggatcatcaacgaattacggaatttccttatcatgcccggctgacagcaagcgacagtctgcttatttcaaaaacgggaaaagagcctttattgtatagtgtctattcaatgaagcgtgtgatgaatgctcgtcagagtgatgctttcaaggtggaggtgactttggaaaaagactctttggtggcgggtgtacctgttacattgacagttaccttgcaggtgaaacaggagggtgcgcaatatgtgatgctcgaagttcctgttccggcaggttgtagttatgcctcaaaacctgttaatttctcccgttctgaagtatatcgtgagtattttaaagagaaaactgttatctttagcgaaaaattaccggtaggtacttatcagtttacggttcctttgcttccacgctttactggaaaatatacgctgaaccctgtgaaagtggaactgatgtatttcccggtggtgaatgcaaataatgcggggggagaaatttggattacagaaagaaatacaaaagatatacgaaagaaagggaatgattgaagcgatgaaatatacgaagtggataacagtcttgttttgtcttttgggcttggcggcctgtcggcaggatgcgcctcgtttccgtattggggtggcccaatgtagcgatgactcttggaggcacaagatgaatgatgagattcttcgcgaagcgatgttttatgatggagtgtcggttgaaatccgctcggcggcggatgataaccgtaagcaggcggaagatgttcattattttatagataaaggagttgatttactgataatttccgccaatgaagcggctcccatgactccaattgtggaggaggcctatcagaaaggaatacctgtcattcttgtagaccggaagatactttctgataaatatactgcctatatcggtgccgataattatgaaataggtcgtgcggtaggaaattatatcgcatcaagtctgaaagggaaagggaatgtagtggagcttaccggactgggtggttccacccctgccatggaacgccatcagggatttatggctgctatcagcaattatccggatatcaaactgattgataaagcggatgctgcctgggaacgtgaaccggcagaagtggaaatggatagtatgcttcgccgtcatccgaagattgatgcggtatatgcacataacgaccgtatcgctccgggagcctatcaagctgcgaagaaagccggacgtgaaaaggtaatgatttttgttggcattgatgccctgcccggcaaaggaaacgggcttgaattggtgcttgacaatgtgctggatgcaacttttatttatccgactaatggggacaaagtgatgcaactggccatgaatattcttgagaagaagtcttatcctcgcgaaacggtcatgaatactgccgttgtagaccgcacgaacgcgcacgttatgcaacttcagactacccatatctcggaactggatcagaagattgaaacattgaacggacgtatcggtgggtatctgtcgcgtgtagctacgcagcaggtcgtgatgtatggcggcttggttattcttttattagtagcgggattgttgttggtagtctataaatccctccgttccaagaatcgcctgaataaagagttgtccgaacagaagaaacaagtagagcaacagcgcgataaactcgaagagcaacgggatcagcttatccagctttctcatcaactggaagaagcgactcatgccaagctggttttcttcacaaatatatctcacgattttcgtactccactgacattagttgccgacccggtagagcatttactggctgattcgtctttgagtgaagatcagcgccgaatgttattgttagttcagcgaaacgtgaatatccttttgcgtcttgtcaatcagattctggattttcgtaaatacgagaatggaaaaatggaatatactcctatttcgttagacattctttcttcttttgaaggatggaacgaatctttcatggcagtagcccggaagaagcatattcatttctcattcgattatatgccggatacggattaccgcacattggcagatgtagaaaagttggaacgcatctatttcaacctcctttccaacgctttcaaatttactccggaaaacggaaaagtaactgtacgcttgtcttccctgactaaagacgatcattgctggattcgctttaccgttgccaataccggttcaatgatttctgcggagcatatccggaatattttcgaccgtttctataagatagatatgcaccatgccggttcgggtattggactggcattggtaaaggcttttgtggaattgcataaaggtaccatcacggtggaaagtgatgaaaagcaaggaactatctttaccgttgatttgcctgtgcagacttgcgagactgttgtttctgaaaactctccggcattctctgtgtctgctacttctgtaacctccaccgatgctacaacctctgccgttgctggggttccggcaactcctgcaacttccggttattccggttcttcgagcttgaatgatgctttaacttacgaagaagaggaattggaaaaaagttacgactcttccaaaccttgcgttctgattattgatgataacgctgatattcgcttatatgtgcatggattgcttcatactgattatactgttatagaagctgcagacggctcggaaggtattcgtaaagctatgaaatatgtcccggacttgattatctccgatgtaatgatgcccggaatggatggaattgaatgttgtcgtcgcttgaaaagcgaattacaaacctgtcatattcctgttatcctattgacagcttgttctttggatgaacaacgaattcaagggtatgatggtggtgcagattcttatatctccaagcctttcagttcgcaattactattggcacgcgttcgtaatctgatagattcacaccgccgcctgaaacagttttttggtgacggacaaacgttggcgaaagaggatgtctgtgatatggataaagactttgtggaaaaattcaaagctttgattgaggcaaagatgggagattcaaatttgaatgtggaagacttgggtaaagatatgggattaagccgtgtgcaactctatcgcaaaatcaaatccctaactaattattccccgaatgaactgcttcgtatagctcgtttgaagaaagctgcttccctgcttgcttcgtcggatatgacagtggcagagataggttatgaagttggttttagttctccttcttattttactaaatgttatagagaacagtttggagagagtccgacagatttgttgaagaggaaaggataggatagaatctgcaaaatttggtggtgagcatttatctgtttatacttctagaattcatatgataaaaataagaggtaaggaaatctattgacataccttacctcttatttaattcagtatatgatttactgtatatttattaattcataatcaacttattcgtttttggcttattccaccatctttggttctcttgacctcccgatgttacccattgttcaaagtctggatatgcttccaagaagtttacttcttctctggcatgatgtaaagatgcaggtacttttaatccccatataaagttgtcttcatttacataactttcgttgctgttataataaaccgggctataaccttttaagtggatttcttgtcctttattagtttttgcaatataaaagtccattttactgtcttgtaggcttttaacgttaacaggtgagttgaacaccaagtaaatggccatcatttttttaggctttgttttttcatttacctccgtattataatacttgtatccgttaggaatggccggtttctttagtgaaataatcaattccccttttgggccttttaggattttgatattttcagcctcttcaggattgttacgctcaagatacatttgagtttcttctaaatcaagttcattatattgtacttctgccaagcggatataaggattgtagtcatatatacctcctatagctctgatttggaatcctatcattaagtattctgcataacattgattgtgactccaataaaaaccgtcaatttggaaattataccatgcaacaaaatcattaaaatcataatcgcctaaagctggatacatatcttcgaacataatagttccgttgccatatcccggataattgaagatgttgttcgtttcaacttctttattagctcttgtggtaactctggataatgccgtagcgttagcaggtactactatagaaatagtaccattactttcaacaggaacagtttgtatttcagagccattaccatattttacatacacattttttatatatgcaggaatttcaattgggagttccaattttgatgtgttggcatcgacatccattcgaagcatcaaagcctcttcattgcaattttcttctagaaatacagaaatagtagcagttgattgactggcaattttcactttggcattttgagaacctttccagtcgaaatcggcaggtacttccaagtcagtcatcttcttttctttctcgggttgtttactttcatcataaaggttcttctcacaggagctgaaagccagtgctcccaataaacaagaagcgaacaggatagttttctttttcataacagcagtgcttgttttgttaataatagggttgcttttaatgggtacaaaggtcgggattatttgtaaataaagcaaataaagttgcatattttatttgaaatgcttttattatttgcaaattcttttctttttatctagttttggaactgaaataaagtaatgtttgagtgatgaaagattataaagtagataaggcgagcctttccgcatccttttgtcaagaggtgtatcaggttgtccgagaaattccggtaggtaaagtttctacctatgggggaattgccgcattattgggaatgtctcaatgttcccgtatggtggggcgtgctttgaaacagattccggatgatttatctgcgccttgtcatcgggttgtcaatgcgtcgggacggcttgttccgggttggacagagcagaaacaactcttgttggaagaagggatctctttcaaacaaaatggatgcgtagacttgaaaaagcatctttggaattactccgtacctgaatgaaatttgcatatttaatctattttccttacctttgtgccaacaatatgcaagaacagactgttatttatttatgaaaatactgttttctactgttcattaagaggataatcttatcaaattctattccttttaaactactctgtctgtttttttttaaccatttaaaaaacgtcggaccgtcatgttatcatgtgacatgactgaaccatgcgaacattcaacttgtttatcgtaagtgagaataaggaatgcggcagttgaaaacaaaacaaatattataatctaaaccaatatattatatgagtaaaatagaaataaaggatttgtaccttatctttggtaacgagaagcagaaagccctcaagatgttgaaaaaagataagagtaaagaggaaattctgaaagataccggttgtacggtaggagtgaaagatgccaatctttcaattaatgaaggagagtttttcgtgataatgggactctcgggaagtggaaaatcgacattactgcgttgtatcaatcgtctgatacgtcctactaccgggcaagtgcttgtaaacggagtagatatatctaaaatttccgaaaaagaattattgcaggttcgtcggaaagagctggcgatggttttccagaatttcggtctgttacctcaccgttccgtattgagcaatatcgcgttcggcctcgaacttcagggagtgaagaaagaggaacgtgagaagaaagcgatggaaagcatgaagcttgtcggattgaaaggatatgaaaatcagatggtaggcgagctttccggtggaatgcaacagcgtgtcggactggctcgcgctctggctaataatcctgaagtgcttttaatggatgaggctttctctgctctcgatcctctgattcgcgtacagatgcaggatgaactactggccttgcaatcaaagatgaaaaagacgattgtttttattacccacgacttgagtgaagcaattaagctaggtgaccgtattgccatcatgaaagacggagaagtggtgcaggtaggtacttcggaggaaatcctgactgaaccggctaacgattatgtagcccgttttgttgaaaacgtggataggagcaaaattattaccgcctcttctttaatgattgacaaaccgttggtggcccgtctgaagaaagaaggtcccgaagtattgattcgtaagatgcgtgcgaagaatatcaccgtattacctgtcatagacgccgatgataaactggtcggagaagtacgtctgaacgacttgcttaagttacgtagcaaacaggaaaaatccattgaaacgattgtgcgtacagaagtacattctgtgttggaggatacggtgttggaggatatacttcctctaatgacaaagagcaattcgccggtatgggtgattgatgagacgcgcgagtttttaggaacaatcccgctttcatccttaatcatcgaagtgaccgggaaagataaagaagaaataaacgaaataattcaaaacgcaatagatttatgataaatataggacaatatatagagatggccatcaattggatgatgatacatttttccactttctttgatgccgtgaatgcgggcatcggtagttttattataggattccaacacatacttttcggaatacctttttatataaccattttggtacttgctgcactcgcatggatgaaagcaggacgcggtacggcaattttcaccgcattgggattattactgatctatggaatgggattctgggaggctaccatgcaaactctagctctcgttttttcatctacctgtctggccctgattgttggtgtacctttaggagtatggacggcaaacagttcgcgtgcagagaaaatactccgtcctgttctcgacttgatgcagacgatgcctgcttttgtttatctgattcctgctgttttgtttttcggattgggagcagtgccaggagtgtttgccaccattatctttgctatgcctcctgtggtccgccttaccggattgggaatccggcaagttcctaaaaatgtagtggaagcttcccgttcgttcggagctacccgttggcagttattgtataaagtgcagcttcctttggcgttgcccaccattctgactggtgtcaaccagacaataatgatgtcgctttctatggttgtaattgctgccatgattgctgccggtggtctgggagaaattgtattgaaaggtattacccaaatgaaaatcggacttgggtttgaaggtggtatagcagttgttattttagctatcatcttagaccgtatcacgcaaggaatggcaggacgaaaaaataagaactaaacggaaaggataaaatacgtatgagaatatataaaatagtaggaatagtattgtcagctatgcttttgctagcttcctgtactaattcagacttagagaaaaagaaagtaaaaatagcctatgccaattggctggaaggtattgccatgagtcatttggctaaggtggtattggaagagcatggatatgaggttgaattgcaaaatgctgatcttgcccctatttttgtatctatgtcaggaaagaaatcagatgtgtttctggatgcatggttaccaataacgatgaaagattatatggatcagtatggagacagcatcgaattttttggggaggtatacggagaagctcgcgtcggactggttgttcctcaatatgttacgatccactctattaatgagctggaagctaataaagaccgtttttcctctgaaatagtaggaattgatgcgggagcagggataatgaagacgaccgataaggccattgctgcttacggacttgatgggtataccctcatgacttcaagtagttccaccatgctggcttctttgaaaaaagcgatggacaaaggagaatggattgtcattacggggtggacaccgcattggatgttcgaccagtttgacttgaaattcttggatgatccgaagaaagtatatggagacttggaagaaatacatgctattgcatggaaaggattcagtgagaaagatccgtttgctgccgaattctttggcaacatcaaactaacgacagaagaacttagctcttttatgacagctatgaaggatgccaggatggatgaagaagaaatagcccgtaaatggagggatgagcatcggctgttggtggatagttggattccgaagtcagagaataaatagattggagcattgttattcttaattttaaatataaaatagacatgaactctagtgggaaaaagggagtactgtttatgttggacagagttcatacaataaaaaagcggtaatctttgataagattaccgctttatatttatagggtattactattattcagcaccccagttttctctagccaaacgtttgtagctgttgtaacgccatttagcgttttcttcagcagctttaaacagttcttcagcttcagtaggatattgtttcattacagaagcgtaacgaacttcacccttcaagaaaccttggaaatcttcccagttcggttctttgctatccaattggaatgggttcttgccttcttcttccaaagctgggttgtaacgccacaagtgccagtaaccgcacttaacagctttttcttcttcttcctggctcttacccatacctgctttcagaccgtggttgatacatggagcgtaagcgataatcaaagatggtcccggatatgcttcagcttcacggatagctttcagagtttgagcttggtcagcacccatagcgatctgtgcaacatatacataaccgtaagtagtagccatcagaccgaggtctttcttacgtacgcgcttaccagcagcagcgaacttagcgatagcacctaccggagtagccttagaagactgaccacctgtgttagagtaaacttcagtatccagaacgaggatgttaacgtccttaccggaagcgattacatggtcaagaccaccataaccgatatcgtaagaagcaccgtcaccaccaatgatccattggctgcgttttacaagatattgagtcagtcctttcagttctttgcaaataggacatccgtgagaaagaccttcttcaatcactgctttcacttggggagccaattctttagtcttgtcagcatcgtacatgttttcaatccatgctttcagcacttcttttgcttcaggtgaagcgttgtcggcagcaaggatttcgttgaataacttcacgatacgagcacgcatcttttcgttagccaattccatacccaaaccgaattcacagaagtcttcgaacagtgagttagcccaagcaggaccgtgaccgttttcgttcgtagtatacggagtagaaggaactgaaccagagtagatagaagaacatccggtagcgttagcaaccatttcacggtcaccgaacaattgagaaatcaatttcacatacggagtttcaccacaaccagagcaagcaccagagaactcaaacaacggagtagcgaactgtgagttcttcacgttagacttgatatcaacaagatgttgtttagtcttcacgttttcagcacagtaagtccagttgtcagcttcagccaattggctttcgaggtgtttcattgtcaatgctttgccacccttcttcggattacccggacagatgtcagcacagttaccgcaacccagacagtcgagaacgtcaacctggatacggaatgtcataccgtcgaatactttacctactgctttcaattgttcgaacttagcacccttctgctcttcagcatcgagtacgaacggacggatagaagcgtgaggacaaacgtatgcacacttgttacactggatacagttttctggattccattcaggaacgaatgcggctacaccacgtttttcgtatttagaagtaccttgataccaagtaccgtcttcgatacccttgaatgcagatacaggcagcaagtcaccatcttgtgcattgatcggacgaactacttcgttgatgaatgcaggatcgttgttttcagcttttgcatcatccggcaggttagcccaagcaggatcaacagctaaagtcttgtattcaccaccacggtcaacggcagcatagttcttgttaacaacgtcttcacccttcttaccgtaagacttaacgatgaatttcttcatctgttcaacagcctggtctacaggaataacacctgtgatacggaagaatgcagattgaaggatagtgttggtacgattacccaaaccaatttccaatgcaatctgtgttgcgttgatatagtatacggaaatgttgttctgtgcaaaatatttcttaaccttgttaggcaggttcttagccagttcttcaccttcccagatagtgttcagcaagaaagaaccgttcttacgcaaaccacgagttacatcgtacatgtgcaggtaagcctgaacgtgacaagcaacgaagttcggagtatttaccaaataagtggaacggatcggagtatcaccgaaacgcaagtgagaacaagtgaaaccacctgacttcttagagtcataagagaagtaagcctggcagtgtttgtcagtgttgtcaccgataatctttacagagttcttgttagcacctactgtaccgtcagcacccaaaccgtagaatttagcttcgaacattccttcaccgcctaaagcgatttcttctttttgaggaagagaagtgaaagtaacgtcgtctacgataccgatagtgaagtgattcttcggcattggcatggccaagttctcgaatactgaaagaatttgagcaggagtagtatcttttgaacccaaaccgtagcgaccgccaacgataaccggagcattttctgcgccgtagaagcagtctttaacgtcaaggtaaagaggttcgccgttagcgcccggttctttagtacggtcaagaactgcgatagtcttggcagtcttaggtacagcagccaggaagtgtttagcagagaacggacgatacaggtgtacggcaaccatacccactttttcgccatttgctaccaagtggtcgatagcttcgcgggcagcttctgttacagaacccatagcgataattacgcgttctgcatcttctgcaccataataatcgaacaaaccgtatttacgacctgtaatcttagaaatttcattcatgtattcttctacgatagcaggaactgcttcatagtagttgttgcatgattcacgatgttggaagaaatggtcaggattttcagccataccacgagcaaccggattcatcggattcagtgcgcgggcacggaattcagccaaagcttcctgatcaatcagcggagcaagatcatcattttccaacatttcaatcttctggatttcgtgagatgtacggaaaccatcgaagaagttcatgaacggaacacgagatttgatagtagccaagtgagcaacaccagccaaatccataacttcctgtacagagccttcagccaacatcgcaaagccagtctgacgagctgacattacgtcttggtggtcaccgaagatacacaatgcgtgagaagccaatgtacgagcagatacatggaatacgcaaggcaagaactcaccggcaattttgtacatgttagggatcatcaggagaagaccctgagaagcagtgtaagtagtagtcaacgcaccagcctgaagagaaccgtgaactgcaccggcagcaccaccttcagattgcatttcctgtaccaatactgtttcgccgaagatgttcttacgtcctgcggcagcccattcgtctacgtactcagccatagtcgaagaaggagtgatggggtagatagcagctacttcagagaacatatacgagatatgcgctgcagcctggttaccatcacaagtgatgaatttcttctgtttagtcataactaaattaaatatttaagtaaataaatcttttaatataaaaagccgaacatccagagaggtatctggttgccccgacctatttcagccttatgcaacgcgtacgtcacatttggattgttcttgatctttgctccttcctggcaaattttgaacggcattacttcgtccaccataaaagagacgtttttatctcctttatgtaccttatggtctttccataaagaattcacaaagaaagtgtcgagcacatcctgctcctccactttcaccgggtagatggaatacatcaggttggagttgtgcatcattatcttcgaaggttttttagggaattcttcccctttcggataaaccagattaatgagtcgcgcatctgccagatacttgatatagttcatcaccgtggcgcgagatgtctgtatgtcgcttgccagttggctcacatttggagctttcggcccgtcgacagcgagcaaatatagtaatttttttatctttgaaagatatttcagttcaatttgtttgatgagaagtatatctacttccaccatcatgttcatcgttttcagcaaattctccgagaagttacgcttctcgaggaagaacggatagaacccatgatgcaggtaatcctggaagtaatccagcggacgaactttagagagtactcctttggcaatctgttcgtgagtgctaagaatttcttcgaggctgtatgccctgaatttcatgcctgtctgtaagttcaggtattcgcgaaaagaaaatccgcgcaggttatagctcttggcgatatcacgtaattcaagattttcttctttcagtcgcatcacggacgagccggtgaagacaattttcaggttaggaaaacggtcgtaacacatgcgtaactctttgctccattccggatgtttgaacacctggtcgatcaacaatacttttccgccacgtttctgaaattcgttagcaaagtctacaatgctgtggccagagaagtagaagttgttcatgttgatgaacaggcaggagcggtcgttcccaaatttttctttggcgtattggagaaggaaagtggtttttcctacgccacgtgtccctttgataccaatcaggcggtcgctccagtcgatctcgtccataagatcgcggcgaacgggggcattggtgtgctcaacgaggtaggcgtgtgtgcgatagaatgattccatttcagttctttgtttttcgggtggcaaatatactgctttttttaggatttgcaaagtagagatggcaaaattgtgagtttaattagaactttctgtttattgtagccattcctgactatttcctgtatatatttgcagaataaagttttgaattcgtttaaaatgacaaaaaaggctctttatatattcaatccggaacatgatttggcgttagccagcggtgaaacaaactatatggcaccggcttccgcccggcagatggcatccgaattggctttgttgccgatgtggtatgcagaagagggaagtgttgtattggctccttccgcttataatctcgactatgtgaagaagatacaggaattattaggactttcggttgatttgatgacagaacctgaacttgcttcggagcggaatttggatattcgtccttggggctgggatatagcaataagaaaacgactgttggatttgggagtggaagaaagcgagcttccttctattgagcaattggataaactgcgtttctgttcccatcgttcctgcgctgtgggattattaccacagctacaactgggagcctgtttttgtggagagtctttttacctgacgtttcccgaagaatggaagtcatttgtagaatcacatgatacttgtttactgaaagctcctttatccggtagcgggaaagggctgaactggtgcaaaggtgtatatactccttctatttccggttggtgctcacgcattggcaaacagcaaggaggtgttattggcgaacctctatataataaggtggaagattttgctatggaatttcgttcttcgagtaatggtcgatttggctttgccggatactctcaattccgtacgggtggaagtggggcgtacgaaggtaatctgctgatttcagatgcagccatcgaacggaatcttttggaatatatccctgtcgaagaaatttataaattgcgcgaccgccttgaacaagaattatccctccgtttcggaaccatttataatggttatttgggagtggatatgatgatctgtcgctttccagaatctcctgtttatcggattcatccttgcgtggaaatcaacttgaggatgaatatgggagtagtagcgcgtcatatttatgaccattatatctatcctacttcaacaggagcttttcaaataagctattaccctacggaaggaacagcctggagagcacacaaagaaatggaggaggcttatcctttggaaatagaacaaggaagaataaaatcaggctatttgtcattggtgccggctcataaaaagagtagttatcgggcgtgggtgtttatctcaaaaagcgtgtttttgtgatattatatcgaagttatggtttctcggtgtgaaactgatagtttcatgtagtgaaaccattggttccacaccgagaaacaaaaagtttcattgcatgaaacaagtaatcacatgccatgtgtgtactgtactggatttagttgacaacttcgcttgttatacctaagttagtttactaaatccataatgcttcatttttatacatcgcaaaaatataagaatgaaaaaagggcgacaagatagaatcgcggagacgcttactatcaagaatatccaaagcatgagcggttgatttgccagaaaattccacaacgtattgctggcacttttccagtaattatcagaagtgccttgagaaacgggctcatagtcgcttccataaagcaccaatgttacagcccggactccctctgttattcctctgtcaaagtcgttttttctaaaccacggaaccatttcattctgttgaatgcgaaagcataaagcgtcgggaagtactccttccaaaccgtatccggttgcgaaagtgactttacgttgatcgagcactaaaagaatcagtaatccattgtcgtccgctttctttccgatgccccagtgttcaaaaagcttgtgggcaaactctgccggaatatcttcaccgatagaagggagtgcaacaactgtcacttcaatactcaatgaatcttctaactgtgacaacatattatttatttcccacacataactttcatccaatatctgattcggattgctgacccaattggaagagctttcattacgcggattggggacatctgttactttataaatatctactgtttgttcgtgctctaaagccaatgcaaaagcatgactaccaaaggtataacagaaaacaagaagtaatatccggactattcccctgaaacttttttgtgttttatctttcattattgtgttattaactgattgttcttagagtagaaaataactatcataactctcattctttttgctaatatagttattatctgatgaataagaatgatagatgtttctgaaattttgtatctatcatactttcttcatgaaatatgggtatctatcatacttattcttttaattataagtggtttataaaaatgaatgagagtatgatactagttttttactcatagagaagatgtttttttctaatctctttgtaatcctgtaactccttttgccaactattccggatagcctcttccgattctcctttgaggatagccttgcgtacgctgtcagttcccatcagcaaatcaaaccatcgggcacgggagaagaaggctgcgctttcaccggataagcgataaaagttcaagaagtagcggagtgtaaatccgttcacatcggttacattccggaggtcttccccatagcaggtgatacctttgtgcatcggttttttgtcaaaaccgggtaaggagcggggagtaaaagtgaaacttccgtatttcttattaggtgcgcctaatacttggaaaggaaaagttgttccccgtcccacgctgacgcgggtagcttcaaaaggacagagtgaagcatacaatcggatagactgatcgttcgggaggttgggcgacggtttgatggggagtgaataaggctctccatgtttccacccggtcattggaattacctttaatgaacaaggatttttcttgttggcaatccatccttccccgtttatcatctgtgccagttcgccgatagtacatccgtgaagtacaggaatgggaagcatgccgacaaagctccggtaagcaggtttgagtatcggaccatccacatagtcgcacggattggggcgatccagtacaatcatttctttcttgttctctgcacaagcatccatcacataatacatcgtgcttatataggtataaaagcgtgcccctacatcctgaatgtcgaataagatcacgtcaacatcttttagttgggtggcagacggctttttgttatcaccataaagcgatacgataggaataccggtgcgggaatcttttccgtctttcaccgtttcacctgcatccgcgttaccgcggaaaccatgttcgggggcaaatgctttgactacccggacgtctctccttaataaggtatcgagaagatgaacccgctttgctcccacgacagaagtgtggttgactaccattccgatgcgttttcctttcagcaacggcatatattgatccatttgttctgctcccgtgacaatttgactgcttacacgcattggtgacaacataatgaatagaaatataagaatgaaggaagctcgagtttgcatatcggtaattttttttgtaatattgcacaaaaatattaatttctcatcaagagagcaaaaaataaagcacatgaatccatacgaaatcattgataaatattatccggaaaatacgcagcagagacaaatcttagtaattcatagtctggcggtgtccggaaaggcaatgaaaatgctggatgctcatcccgaattgcgtttaaaccggagttttgtgaaagaagctgctctgttgcatgatattggaatttttcagaccgatgctcccaccattcagtgctttggcactcatccttatatcgcccacggatatttgggagctgaaatcttgcgggcggaaggtttcccccaacacgcattggtgtgcgaacgccatacgggagccggactctcgttggaagatatcattgcccagcagctccccgttcctcatcgtgagatgctgcccattaccctggaagagcaattgatttgctttgcggataaattcttttctaaaacccatctggatgaagagaaaactgtggaaaaagcgcggcaaagtattgcaaaatatggtgaagaaggcctaagccgctttgatagatggtgttctctctttttatagcactaaaaaataattaaataacgaagattctaactcatatttggtgaagattgtgtacttttgccacttcaagcgtaaactattagttaatggcgccattgaaagcaaaaatacttatatcattcatactgctgattgtcttactgatgcttcccgatgaggctacgtctcagcgtcgaagaagaggaatgattgcctccaataccgcacaaacggattcccttcagggaaatgattcgttgaaagcagatacggtaacggtacgcattgattccatcgcaccggtaaagaagaaacaaccactcgatgcaccggttgtttatgaatccaacgactccactgtctttactttgggaggagctgctacactttatggtagcggaaaagttaattatcagaacatcgaactcgctgcggaagttatttcgatgaatctggatagtagtactgtgcatgcttacggtatcaaggatactaccggagtggaaaaaggtaaaccggtatttaaagaaggagatacctcttatgatacggaaaccatccgatataatttcaaaaccaaaaaagcgggaattaccgatatcgtcacccagcagggagaaggatatgtgactggaagcaaggcgaagaaaggagctaatgatgaaattttcatggagcatgggcgttatacaacctgcgatcatcatgaccatcctcacttctatatgcagctgacgagagctaaagtgcgtcctaaaaagaatgtggtgacaggacctgcctatctggttgtggaagatgtgcctttgccgttggccgtaccgttctttttcttcccgttctccagcagttattcttccggtttcattatgccgacttatatggatgactccagtcgtggtttcggtctggcagaaggaggatattactttgccatcagtgatattatggacttgaagatgacgggtgatatcttcacgaaagggtcatggagattatccggattgacaaactataataaacgctataaatattccggtacgctgcaagcggactatcaggttaccaaaacgggagataaaggtatgccggactatacagttgctaaggactttaaggtagtatggaaccatcgccaggatgctaaagccagtccgaacagtacattctccgctagtgtaaacttctcaaccagtagttatgaacgttccaatatcaacaacctttataattcgcagttgttgactcaaaataccaaaacatcaagtatcagttattctcgtagtttccctgatatcggtctgactttatccggaaccaccaatatcgcacagacgatgcgtgactcttctattgcggtcactttgcctgacttgaatatcacattaagccgtctgttcccgttcaaacgtaagaaggcggcgggagctgaacgctggtacgaaaagatttccattagctatacgggacgtttgacaaacagtatccgtacaaaagacgaccgtctgtttaaagccggactaagcgaatgggaaaatgcgatgaatcataacattcccatcagtgctacttttacgttattcaaatatttgcaggtttctccttcggtcaattatacggaacgttggtatactcgtaagatcaatcagcaatataatgaggtcgatcataagttggaggcattgccgggtgatacgttaaacggtttttaccgggtatccaattattcggcaagtttgagcttgagtacgaaattgtatggtatgtacaaacctctttttgctaaaaagaaagagatacagattcgtcacgtattcacaccgcaggtaagtcttagcggtgctccgggattcagcaagtattgggaagaatataccgattataatggcaatacgcaatattattctcctttcaccggtcaaccttatggcgtaccttcgcgggaaggatcgggaacggtcagcttctctatttctaataacttagagatgaaatattacgatgcaaagaaagatacgcttaaaaaggttagtctgattgatgaattgggagcaagtatgtcttataatatggctgccaaagagaggccttggagtgatttaagcatgaacctacgtttgaaactgactaagaattatacgttcaacatgaatgcatcgttcgctacgtatgcttatacattcgataaaagtggtaatgtagtaactagtaaccgtacagaatggtcgtatggtcgttttggacgtttccagggatatggttcttctttcaactatacctttaataatgacacatggaagaaatggttcggtccgaaagaggaggatgaaaaagggaaagataagaataagtcggaggatagcgacgatgaggaatccgatggaacggaaggagacggtactacgcctaagaaagtagagaaagcacaggctgacccggatggttatcaggtatttaagatgccttggtcattgagtcttagctattcgtttaatatccgtgaagatagaacgaagcctatcaaccgttattccatgcgatatccttatacttatacgcataatatcaatgcaaacggaaatataaagatttctaataactggtcgctctcattcaactcgggttatgattttcaagcaaaagagattacccagacttcttgtacaatatcccgtgacttgcactgtttcaacttgtccgccagtctttctcctttcggacgttggaagtattacaatgttacaatccgtgcgaatgcaagtattctgcaagacttgaagtatgagcagagaagtcagacgcaaagtaacattcagtggtattaaaggggaaacgataatgaatgtttagcgataacgtaaagagtaagcgatagagcataaaataaaaacaatgagcggtgaacaagatatgcatttatattgcattagttgttcaccgctcattgtttttatttcactgttatctatctaccatgcgatttctgtttctccatgtgcttttagataatcgtttgtacggctgaaatgtttgtttccgaagaagccgttgtaagcagaaagaggagagggatgggcggaagtgagtaccaagtgtttgttgcggtcgataaacgctcctttcttttgagcgtatgatccccacaggataaataccaggttttctttttcttctgccagggcacggattgcagcatcagtaaatgtttcccagccacggttctggtgtgaaccagcttggtgagcacgtacggtcagcgtagcgttgagcaacaatactccctgttctgcccagcgagtcagatttcccgtagcaggggcatctgtgccgatgtcggccttgatttctttgaatatattcactaatgaagggggaaaaggcactccgtcgtttacagagaaacagagaccatgcgcttgtcccggtccatggtaaggatcttgtcctataattacaactttcactttgtcgaaaggacaaaggttgaaagcattgaagatcagttttcccggagggaagatctgatactggctatattcgcttttgacgaaatcggtcagtgtgcgaaagtagtctttttcgaattcgggttctaaatgtgctttccagctttcttcaatttgtacattcatagtttgttatataaggtgtatttcaagttcttcacattccttgcgcatatcttcgggccagatgctggcttgtatttctccgatgtgagctttgcgaaggtagaacatacacaagcgggattgtccgatacctcctccgatagacaggggaagggtgtcattcatcaatcgcttgtggaaataaagttccagtcttttttcttctttttcttcttttaactgacgttgcaaggcttctttgtctacacggattcccatcgatgataattcgatggagcgttgcagtacattatcccacaataggaggtcgccgtttagtccgggcaggtcgttcagtcctttggtagtgtagtcgtcatagtccggtgcacgtccgtcgtgcttcttgccatcaccaagttgacagcctattcctatgataaacacagctccatatttctgacagatggcatgttcgcgacatttaggttccaggttcggataaagctggcgcaattcctctgaatgaatgaaatgtagcttttgcggcaggcaaggtttgatttgcggatacatttcatataccatatattctgtacggatcatagccgcataaatacggttgacgatttcctttaggaagttcacagtccggtcttcattggtgataacacgttcccagtcccactggtctacgtagagagaatgcagattgcccagttcttcgtctgaccgaatagcattcatatccgtataaataccatatcccggttcgatgtgatagtcagctaaggtcaaccttttccatttagccaatgaatgaaccacttcggcttgcgcatcgcccagatctttgattgggaaagaaacaggtcgttctattccattcaaatcatcattgatacccattcctttcaatacgaaaagaggggcagtcacacgtctaaggcgtagttcggatgacaagtttaattggaagaactcttttatttgcttgattcccagctcggtctgtttgaggtcgagtagcggcttatagttcttaggttttatcaagtaactcataggtttgttaaatgttaattgtcggcaaagataggaataaaattgatatatgtaatggatattctctaaaagattgtcaatttgataaagtaaatgctctaaagcatttcaaaataacagtcttctaatatagggaagtaccttaagaactataaaaaaaggagaatcattaggaagatgagaagattttttatacttttgtcctcgcatttagaaagaatggccccgtagcttagtgaatagagcgtcagattccggttctgaaggtcgtgcgtttgaatcgcaccggggtcacagaaaaatcccttgataatcagttgattattgagggatttctgttttcttataccttggataactaaaactaaatgcaggatttagcccttgtaattgatttttgttggtctattgttgttcccaagaaaccaatgttatatgttgactatcaaagtgaaatctttcttttatctcgtaagaggttctattattagtctttctttgtataagaattacaaactaatcgtctatttgggtcatctggaaaatccggattagttatttgattataaaattcccagtctctttcaagtctttgggctacatctatgttggctgtatagcagatgtattttttatttgctacatccagaatgccataggtaagaatatccttttcctttccctccttatttatatatgtactcttgaccaataatatcttatattttccgtcttcccgagtacagtattctttattgttctcaagagtatatgtgccggagacatctgtaaaatcattggaggccatttctacgataatctgtttgggctctcctgtttccggagtgtctgtcgagtcattgttgcatgcggatagcaagatggcggataagaataatagtttaagtaatttcatctttatattttatttgtttttgatcctttttttagtctagtatattatttatagtgcaaatgtacagtttttgtgtgatataaaagcggtaatgagtaaaataaatgtgtttcatattcttgatatttagattcataatccttagatagtcagtcatgtattttgctttgcattttctcaaacctagttagttattattgtatgtagttgcataatttagcctaaatagaatgaaaaagttgatttaaataaaaggattctcgtgagaaatgctaactttgtagatatgaaaaagtaaggaatgatattctgtagtagtatgttcatagctttccagatgtagacatttgacgataaattatattaatcccaataaatataaataagaatggaagaagctagaaaaaagaaatgggctagtgtggcgctgattatcggagctattggttttatcattattatgatttactttacagttatttcaagtctcaacatgtaaaacagatcattatggcgttgaaaaattaaagcttggacatttcgtttgaatctgtccaagcttgttttttatggttccggatgattgaccggcaatatggtaacgctttctctttagcttcttgaaacctgaagtcccttatcagaaagagtcatttctacaaaacgagcacgaggattgggggcttgttccgtcagtatccgtcggatttgtccggctgcttgcgggtctttggctaccatatataaatagcctccgccacctgcaccggggagtttgtatcccagggtgtaatccttgattttttcgataatggctgctactgccggtggattggttccgcagtctaatgcctggttctgtatccaggttttgccgaccaaacgaccgaaactctcgaaattacttcgtaaaatggcttcactcatatccattgcatgagctttcatttcggccagcaagcttagatgcggaccggaattgaggaacatggaactgacgatctctgccaaaatacttttagcagtacgagtaattcccgtataatataacagatgacagtcgcggtaatcaggatgaacaaagagctgatcgggtaaccagcgtactaatggattctgttcgaaaccagtttcggattgaagcaacttaataccggaaaagacaccgccatattgatcttgccaacctcctccagtggtcaggagctgttctaatactaatgtgtaactacatatatcatttttatcccaagccaatccgcagaaatcattgattgctccgagcacggtagatgccagtatggaactggttcccaagccagagcccgcaggaatagcagccagcagagtaatttcgattcctgaaccgaaatcttccagctgtttagctaaagaaggataagattccgtagagaatgccggtgcaaagcccgccaatgtaagggcggctttcggaatagagaatggagaacctacctttttataatcttgcagttcctcgtaattccttatcacttccattgcacccatgtcgatagagcgaagagtgatgtgatattccttgcatggtttcacatatacttgtagcggtggttgaccgtttagttcgatagcaagatttacaacacttccccctgaataaagagagtagggaggtgtgtccgtccatcctccggccacatcgatacgcacaggactgcgtccccatacgatttgatcggaataaacgttgagtatgggatggctctttcgttcgctcattacccccaataaaccgtcgcgaagcagttgaaaggctgcctgttcctctttggcacaatccttgtcttcacgtagtttcatgatacgtgcacgaagcatccggttgtgtatccgtaacatgggggcagcatcttctttcaagacgtcaggcatgtccagattgaaacgtacaaattcatttgcggcatccagcaaatcgagttgatagaatacgctcttctcataattggccgccaatcctttccagttctccttacggaaagcattgcgctgttcgtaaagacgcttgaggttggcgcttgcggatatttcgtctgcagaaactttttctgctttcaaccaaagttttttcccttcttccagttgtggctccgaggtcatccagcgtactaatatgcctaaatcttcaacagaagccactttggggaagatggatgccgattgtaaatcatctgtacgcccttttatatcctcccaggtaattcctctatcttccatccaacgggtaaaaggaacattaaggtaagtagtcgttattttgtccaacgctcctttgaatacatcatccaatccatacggacgcgcaacaaactcattctcaccgataggaataatgtcgatgcaaaccccatccggcaaatttatgctccactggttttcaggaactcctgtaataatctggcgggaacctaatttccattcttttcccacttggctattctcaatccataaattggcgttgtcggcagaaagagaaacttgtgtgatggaattctgtataaagatagccggatttggctttactttccggtgcatgattcttctttggtcccgtaccttgtcctgtatggctaaagtagaagaaatcagttcgtgacttgtgccgtaatggtagaattctccacctggcaacggcaatatagctacggataactgattgatttcttcatctttcgttttaggatgctctcccaaagccaaaccatagtccgagtataagtcataataagtaatatccttcgtaccttctttcaatgaccgtttcatcaatacttctatggcgcggtcactcaaaatccagatgccgatatccatcaggaaaagatgagttttcgacaatccttccaactcttccaaagaaggtttctgcaacatgaaatcgagcacctccggttttttccggtcggaaacaaacacgccatgatgagttgccaatgaaggattcacccacagcccgtagcatactacatctgcgttcggaatatcctgaagcggtttttccgaacggatatatacgtctccgctagcaatcagcgtattcagaccggccggagcctgattcataatcctttcatagagcgggagctgcaatgataacagattctgtcccagcttttgtcctctttcccaactgaagatcgggataggagttaatattttgccggaagggccgtagctgggtagccgacggctttgtccgcctgcatggagcaatatttttttttcgtgtcctatccagttgctgaaagactcttgtggagcgaatgcctgatggcaagcttgcaataaccatgtggttccgccgccggagcctagtttgctccctatggggtctgatgtacaaaaccaatcggtatggttaacttcttccagttcgtggaagcaatggatcaaattgggtggtaaagataataacttttgcatagtagaatctgcgttggcttagatagaatctaagcgaattaaactcccgtaaaaatactatttatattcctgcttttcaatatttttcttctgttttgaagaataaattttcttttcagcttttagatgtcattttcagtcatcatgtcccaggtgtcattaagtgcctgcatggatggaaataataaatcagccccggcatccagcaacacttgcccgttcaaaggacccgtattgactgctatggtgaaaatacccgcgttgtgtccggcttccactcctaacggagcgttttctactacaaccgcttcatccgctttgatccctccttttttcaaagccatcaaatacggctcgggattgggtttgccatattttacatcgaacgctgtaaccatcagttctttgtgaaacattcccggatagtggtgttccagccgttcgagcagggataactgaccggagccggtgaccaccatcggaatcagcccgtccttcttcactttttgcagtaactcccatgcaccgggcataggctttgcttcgggatatgaattgaacaaaacacttttctcctgatagatactttctatctcctcctgtgtggcttctctacccaattcacgttgaaaaacaatattgattgtagaggctcctgtccgtccttcatgcatatatgcttcttcgcgactaagagtgagcccatgagatttcattactttatgccaggcttccgaatgataaggcatagagtcaaagagtacgccgtccatgtcaaacaggacggctttcagtttctttttcatactttgtacgttgcggaatctttttaagatgatattttattttttatgagcattttcttcagatcagacacgggaataactacatcgtattgtttcccggaatccttgccgatatatctgtaggtaatatttttattgttctccacgcaggtttttatgaatatctgggtggcaggatcggtctgacttgccagcgttgacacaataccctctttcacttcagctgcgttttcttcaatctggctgataggacacaactcttcgtccacactgcatatataaacaaccgattcacctatgatttcgattttttcgacaacgacttcttcactggcctgcattggaaattgcagattcgccattttcagttgcgcttcaagctttgtctgtccgctttgtgccgggtcggcatttgtattgataacctctttcaattcttcggcagtaagttcgcaaaccgcttgttcgcccgacttattccctacaaatatcatgtgtaatccggaattacacttagccatcaacttcagcatttcctttacatcagcagccggattctgaaacatcattttgatagatgatttcatgctttccggattatctttcaaaatcttaatattggtaatttcctcgttcatgttgagagtgtacactacgttatccccgtcgtagatgatactggtaatattgccgacttctcccatgtccagcggacactgtttgttggctatcccgattacagttttgagtttggcttcctgacagccggtcatgactatcattagcaatgatacgctacatagtagcatgagtccactggacttctttaataaatttcctgccattctatttgttttttaagtttgattcgcttcatctacaactgtatacgaggcaaagataacgataaaaaatgagagataagttagaaagggaagatagttgcaaatgatgctcccaagcgattaactacataattatttgctgtttagaagaatatgtgtatttttgtaacgttataaactcgacgatagcatgaaaaagagagtattattgttgctaccattgtttttaggcgcctgctctgatagtggggaaagtcctgttatcaagatagaaaagctttatgcgaagatcgaatcggacggtgaaaataccagttccgatgaaaaagactatgcgaatcagagggatgaactgccggccttgaaggtgggagacgaagtgaaagcgtttctgcttttggatggaaatggagcagagctgaaaacctttaaacttcagaatgacgatgaagtggatactaaactcttttatgagaaaacagaagtatctacagagggaaatctgacagatgtggaaaaaggacagcttcgttttaaggatggggtgtcaaaagccaaaattatggtgattgcgaccattaaacaggtagataagaacggtgatgtgaaattagagttctatctttcttccaaagccgaatgtgaaggagcacaggaagaaatcggtttgaagacgaaagtggaagatgagaagtagaagtggtgagcagtaaacggtacaacgggtaataagcggtacaatcggaaactgcaatcaattgaatataataatgaacggtgaacaaatccatgtatatagcatagttgttcaccgttcattgtttatagtttaccgtttataaaacgttcttgatttatagttttgcacggattgctttggattcctcttcataacccggtttgtccagcaaggcaaacatattctttttgtatgcttccacacccggttggttgaatgggttcacgcccagcaaataaccgctgataccacaagccttttcgaagaaatagagcagaccaccaatgttgtattcgctcaattccggaagtacgatgcgcatattaggtacgccaccgtctacgtgagccagctgcgttcccagttcggccatcttgttcacttcgtccacacgtttgccggctaagaagttcaagccatccagatttgcttcgtcagaaggaacttccagtttgtggttaaccttctctactgaaatcacagtttcgaagatagaacgttcgccttcctgaatccattgacccatagaatgaaggtctgtagagaaatctaccgatgcagggaagatacccttattatcttttccttccgattctccgtaaagctgtttccaccattcgcttacatagtgcagtttcgggcagaagttaacgaggatttcgatcttcttgccatttctgtacaactcattgcgggtagcagcataaatagcagccgggttttcagcaaatgcaacgtccgatccgcatactttttccatatcggcagcaccggcaaccagtttgtcaatatcgaatccggctactgcgataggcagcaaaccaaccggagtcagtacagagaaacgtccgcctacgttgtcagggatgataaatgttttatatccttctttgtcggctgtaacacgggcagcaccttttttagcgtccgtcactgcaacgattactttctttgcagtttccttgccgcgctgatcttcgcattgctttttcagcaaacggaaagcaagagctgtttcagtggtagttcctgatttagaaatattgatgacgccgaatttcttatctttcagatattcagtcagttcgtacagataatcttcgctgatattgtgtcctgcatagatcatgacaggagccgttttcttttcctgcaaccaagtgaagctgttagacaaagcttcgattacggcacgggcacccagatagctgccaccgataccggcaacgattactacttcacagttatctcttaacacttttgctgtagcgttcaggtcggccaagtgttctttagtgatagaagaaggcaaatgcaaccatcctaaaaagtcattacctttgcctgtacctttttcaagcatttcctgtgcggcttttacttcagcttcgtaagcaaaaaccttttctttggagataaatccaaatgtcttttcaatgtttaaactaatcatatcgttcttgtttaaagattatctaaaagagtcagtcagcaatttaatctcgatcattggtgagatacgttcgtataggatgttatacacagcgtccagtatcggcatattgacatgatgatgcttattgatttctttgatacatttcgtaccatagtaaccctctgcaatcatttccatttcaatttgcgcactcttcacggaataccctttgcctatcatcgttccgaaagtacggttacgactaaagttggagtagccggtcaccaataaatcccccagataaacagattcatccacgtttctgttcaacggatgcaccgtgttcaggaaacgattcatttcctgaatggcgttagagatcaatacagcctggaagttgtcgccatatttcagtccgctacagataccggcagcaatggcatacacgtttttgagtaccgaactgtattcgatacccgccacgtcatcactgacagatgttttgataaaactgcttcccagacggcgtgcgaagatacgtgccttgtctttatcagggcaggcgatagtcaggtaggagagtcgctccaaagctacttcttctgcgtggcagggacctgcaaggactgctatattttctggtggtacaccatattcttttgtgaagtattccgatacaataacgttgtcatcgggtacgattcctttgatagcggtgatgataaacttatcttttatcttggttttcagttttttcagatgcgccttcagataaggagagggagtgacgaaaatcagtgtatccgattctttcaccacatcgttgatgttggaactgaacgtgatgcgtcttgtatcgaatttcactcctgtcagataagccggattgtgccctaatcgtttaaaatcggcaatgcggtcgtctcgccgcatgtaccaattgatagagtcttcctgggccagacacatctttgcgatggctgtagcccaacttcctccgcccattatcgctatcttgccgggtaatttcatttgtatggatttggatgaagaacttattaaattttctgtatccactcagttacgtcgtttaccgacggattggtcagttctaatttatatttcttgttaatgccgcagatgttctggtgcagcttctgcggattgacatctttcatgtcggcaactgtgttgtaaccggctttttgaatcaccggaacccagtcttctgcaattcccaattccatgtatttggcagcagcgtcttttttcactactttttccgggcgcatttgcgggaagaacaatacttcctgaatggtagtctgtccggtcattaacatcaccagacggtcgataccgataccgatacccgatgtaggaggcataccatattgtaaagcgcgcaggaagtcctgatcgataatcatcgcttcgtcgtctcccttgtcggccaaacgcatttgttctttgaaacgttcttcctgatccagcggatcgttcaattccgagtaggcattagccagctctttaccgttcaccatcagttcgaaacgttcggtcagtcccggtttagagcggtgcatcttggtcagcggagacatttcaaccggataatcggtgatgaaagtcggctggatatatgtaccttcgcagaattctccgaagatttcatcaatcagcttgcctttacccatcgtctcgtcgatttcttccatcttcagttccttgcagacttggcggatttcctcttcgctcttgccgttcaggtcatatcctgtcttttctttgatagcgtccagaataggcagacggcggtaaggagctttgaagttgatggtttttccgtcaaccactgtttctgtgctaccgtttactgcgatacaaatacgttccaacaacttttcggtgaaattcatcatccagttgtaatccttatattgtacgtagagttccatacaagtgaactccgggttatgggttttgtccataccctcgttacggaagttcttacctatttcatatacaccttcaaaaccacctacgatcagtcgcttcagataaagttctgttgcgatacgcaggtaaagatccatgtccagtgagttatggtgagtgatgaacggtcgtgcgcttgctccaccggcaatagattgcaggatgggagtttccacttccgtgtaaccggcttcgtccaaagcattgcgcaatgttttcacaacagtggcacgtttcaggaatgtttctttgataccgtcgttcactaccaggtccacatagcgttggcgataacggagttcgggatcttcaaaagagtcataagctaccccgtctttgtatttaacgataggcaacggtttgatagactttgcaagtacagtcagtttcttagcatggatactgatttcacccatttgtgtgcggaacacgaaaccttcgataccgataaagtcacctaagtcgagcaggcgtttgaatacagagttgtacagttccttgtcttctcccgggcagatatcatcgcgggtgatgtacacctggatgcgacctttagagtcttgcaattcaacgaaagatgctttacccatcacgcggcggctcatgatacggccggctacggaaacttggcgtggctcctcgtcgtctttaaattcagctttaatatctgtagagaaagcattggttacatactctgctgcagggtacggatcaatacccatcgcacgaagctcattcaggctgttgcgtcgaatgatttcctgttcacttagttctaatatattcatttcgttacgtattaactcaattttggaggcaaaaatacgaaacttttctcatatatcctgtaatccacctcttttttgtatctttgccgtctcaaactaataggtatgacaggacaaaagacacccactgcgttgggtacggaaaagattgggaagcttttaatgcagtatgccattccggcaattatcgccatgacggcgtcttctctttacaatatggtagatagtatttttatcggtcacggggtaggtgcgatggctatttccgggttggcattaactttcccgctaatgaatcttgccgcggctttcggctcgttggtcggtgtcggtgcggctacattgatttcggtgaagctaggacagaaagattatgataccgcacagcgggttttgggaaatgtgtttgtattaaaccttattataggtatctcttttacggtaatcgttcttccttttctcgatccgatactttactttttcggaggaagcgatgaaacggtgaagtatgcccgtgaatttatgcaggttatcttgctcggaaatgtggttacccatttatatctggggctgaatgcagtgctccgtgcttcgggccatccgcagaaagcgatgatggcaacaataacgacagtgataatcaatgtattgcttgctccattgtttatttttgtattcgactggggaatccgtggggcggctacggctacggtttgtgcgcagttgattgcattggtctggcagcttcatctgttctgccgcaaagatgaactgatacggttgaaaaaggggatttttcgtttgaaacggaaaatcgtgttggattcgctggctattggtatgtctccctttctgatgaatatggcgtcttgctttattgtgattctgattaatcagggattaaaagagcatggaggtgatttggcgatcggtgcattcggtattgttaatcgtattgtttttgtctttattatgattgtattgggactaaaccaagggatgcagcccattgcgggatataattttggtgcgaagctctatcttcgtgtgacggaagtactgaaagtaaccatttgttgtgcaactgtagtgacaacgattggtttcctgatcggtatgtttattccggaaatcgtatcttccatctttacttcggacgaagagttaatcagcattgcttctaaaggttttcgtattgtggtatttttctacccgattgttgggtttcagatggtagcttccaacttcttccagagtatcggaatggcaagtaaagccattttcttgtcgttgacgcggcagatgttatttctcgttccctgtttattgattctacctcactattatggacaaatgggcgtttgggccagtatgcctgtggcagatttggcggctagtcttatatccggaggaatgttgtggtggcagttccggcagtttaagaaagttactgtttgataagtttgttccgatattctttaggagatataccgacatactgcttgaaatatttcccgaagaatgattgtgtggggaagttgagtttggttgctatttccttaatacttaaatcggtattatcgagcagatatttagcttctgtaatgacattctgtatgatccactgcaaagcactgctccctgatttctccttgatgacagaagaaaaatatcgggcggacaagcattgcttgtctgcataaaaagtaacatcacgttcctgacgataatatcgataaagggtaatcatgaaattttggaagattttatcctttttatcctgtggcagtggtgtttggggttcgttactgaaataaatgtttaataactcatagcatatcacctgtccccaggatttgattaattcagaaattaaatgttgtttctgacgggaactgttacagatattctccctgttaattcgtttttctacagatttgagcaagttctctacaaatgtatattgctcttcggaaagcgacagacagggattttcccgcaaataaagcaagttttccgagttggctactttgtttactattggtatgacataatccaggtcgacctctatcatgattccttcgaggtcagcgctcctttggcgtatttgtagaagattggcagctgtatatataaaaagattccttttgttaatctgatatggtctacctcccaacaggatttccgcctgtcctttctggcagaggaaaagtccgcattggttgaattcggaaataatgcatccttctttcatggaagtatcctccggagatattataacatacttgaatggcatcagtggttccatattccttttttgttgaaatgaatttctttacaaagtaacaaacaaataaatacaaatagcaaactatttcggctttttatcttaggtaacgtacaaatagaacaatgtttcgtctaaatcaacctttctcctcatgtttgcttgggatacttttgtggcaactaactaataagtgaaaatatgagacgattggacttcttattaacaggatttttagcagttctgttgacttcgtgtgggcaacgtgtacaaaacacagacagtaagccggcagtgaagattgataccgtactttctgccgacagacaaatagctttgcagtttccgggacgggtgaaagcggcacaggacataagtctgtctttccgggtgagtggtactattcagtatatgcatgtaaatgacggtgcctatgtgcgtaaagggcaattactggcagaattagatccgacagactatcagattcagctggatgcggcagaagcagaatatcaaagtgtgaaagcggaggcggaacgggtgatggcactttataaggaaaatgtgacaacaccggatgctaacgataaggccgtgtacggattgagacagattaccgccaaatataaccatgctaaagaccagttggcatacacccgtttgtatgctccttttaacggatatgtgcagaaacgtctttttgattcccatgagacggtagctgccggtatgcccgtcgtttccatcatcagtgagggaagcccggaggtggagattaatcttccggcagtggaatatattcgtcgacagcagtttacccgctactattgtacattcgatatttatcctcatcaaagatatgctttggaactgattagtgtcacccctaaggcaaatgccaatcagttgtacactatgcggcttcaactgaaaaaagaagataaacaggcagttccatcgcccggcatgaatacaatggtaactatcgaatgtagtgaaggagatgtgtgtaacctgtcggttcccggtggagcgattcttcgtgagaacgggcgtacgagtatctttctttatgatgcttccagtcacgctattcgccgttgtgatgtgaccgtcacccgtctgcttagcgacggcagatgcctgattacttcagacggagcgaatcccggtgacttggttgtcgcttcgggggtacatcatgtaaaagagggagaacaggtggaaccgcttcttccggctacagaaaccaatgtgggaggactgctatgattgatattagtaaatgggcatttgagaacaagaagttgatctacttcctgattgccgtactgattgtaggaggagcttattccagttatgaaatgagtaaactggaggatcctgaaataacggtaaagctcgctatggtagtcactacctatcccggtgcgtctgcacatcaggtagagttggaagtgacggatgtgctggagaaaaatatccgctccatggggaatatagataatgtggaaagttattcctacaacgatctctctctgattcaggtagaactgaaaacgactgtcaaagagacggacgtagaacaatgctgggatctgttgcgtcgtaaagtggtgaacgcacaggcagaacttcccgaaggtgccaacccttctattgtaaaagatgattttggaaatgtctacggaatgtttttcgctttgacgggtgacggactttccgacagggaactatctgattattcagaactggtgaaacgtgaagtcagtgaactggatggggtggagcgcgttgacttatacggtaaacgtcccgaatgtattaacatctctctcctgcaagaccggatggccaacttgggtgtgaaacccgccgaagtgctagccacattgaacggacagaaccaaactacttatactggttattatgataatggcgataatcgtatccgggtgacagtcagtgataagtttaagacggtagaggatattggtcgtatgctgattcagggacatgatgccgatcagttgcggttgagtgacattgcccgtattgagaaagattatgaagaccctacccgcaacgaattgttttatgaccgccagcgtgcgataggaatcatggtggctgcttctccggatgccgacattattaaagtggggcatcgagtggaaaagaaactggagcaactaaaggctgaacgccttccggcaggagtagagtgtcataaggttttctatcagccggaacgcgtaggcacttcgttagggacgttcattcttaatctgatagaatctgtgattatcgtagtcgttatcctgatgattgctatgggattcaagagcggggtgattatcggtatcagcctggtagtgacggtattcggttccttcctgttcctttattttatggatggtacgatgcagcgtgtttcattggcctcgttcgtgcttgcgatggggatgctggtggataatgcgattgttatcatcgacggtattttggtagatttgaaagccggaaagagtcggatggaagcaatgactgctatcggacggcagacagcaatgcctttgctgggagctactctgattgccatcattgcttttcttcctatctttatgtcgcctgatacggcaggcgtctatacgcgcgatttgtttatcgtactcgctgtttccctgttgcttagctgggtgctggccttagtgcacgttccgttgatggccgaccggattttgcatccggagatctctgcgacaactgctgctgccggaaagcgtgtgtatgaaggaaagatttatgccgtgctccgttcattgttgagattcagtctggcgcatcgttggagctttgtgtttacaatgatcgctttggtattgctttcagctttcagttaccgtttcatgaagcagggctttttcccggatatggtctacgatcagctttatatggaatataaattgccggaaggaactaactccactcgcgtggcgcgtgacttggaggaaatcgaagcttacctgaaaaaacgtccggaagtcacacacgtcactgcttctatcggtggtactcctgcccgttataacttggtgcgtaacgtagccaatccttccttatcttacggtgaactgattattgacttcacctctccggatgatttggtggataacatggcggaaattcaacaatatctttcgcaacattatccggatgcttacgtaaagatgaaccgctacaacctgatgttcaaaaaataccctattgaagcgcagtttaccggtcctgaccctgctgttttgcatcagttggcggatagtgcccgcaagattatggagaattgcccggatgtttacctgattactacggactgggaaccacagatcccggtgctgactattgagtatgaccagcctacggcacgtgctatcggattgagccggaacgatgtaagcctttctttattgacagctaccagcggcatccctatcgggtctttctacgaaggtattcacaaagataatatctacttgcgttgcctggacgaacacggaaatccgattgagaacctggacaatacgcagatattctcgtctcttccttctctgaacggtttgctgacacaggaaatgatgatgaagctgaagacaggaacactatcgaaagaagaactggtggaaacgttgatgggaacaactccgttgaaacaaatcagtaagcggatcgatgtgaagtgggaagatccggtggttccccgttataacgggcagcgtagccaacgggtgcaatgttctcctgttccgggggtagaaacggagaaggcgcggcaatccattgccacgcagattgaacagattccgctgcctgacggatatcggcttcaatggcaaggcgagaggaacgccagcacaaagtctatgcaatatctgttcaagaatttcccgtttgctatcattctgatgatatccattctaatcatgctgttcaaagattaccggaaaccggttatcatcttctgtactattccgctggtatttgtcggtgttgttgctgtaatgctgcttaccgggaagacattcaactttgtggctatcgtcggtacattggggttgatcggtatgattattaagaacggtattgtattgatggatgagatcactttgcagattaatcagggagtagaacctgtgacggcattgatagacagttcgcaaagtcgtctccgtcctgtgatgatggcttcgctgactacgattttgggaatgattccattgttgccggatgccatgttcggttcgttggcggcttctattatgggtgggttgctgttcggcacgttgataacgttgctttttatcccgattttgtatgcattattctttcatataaaaaagacagacaaatgaaaaaagaaattcttgtagccattagtgtagcgggtgtattgttcggcctgtcggtttcgcttgccgcgcaagaaaaactaagtctggcacaatgccgtgaaatggcactgaaatataataaggatatggctgccgctaataagcagacggaagcagcccgattgatgtctcttagttataaagccaatttcttccctaattttacagccaacggaacgggtatttatagcacagcggatggaagtctcggagttccgggaggaaaccttccggttttcctgcccaatcctgctaccggagaactggtatcgagcggtttcgcttattttcccggattgaatctggattataaggtcggaactgtttactcgggcggtatacaagtggagcaacctctttatatgggaggaaaaatccgtgccgcctataaaatgtcactactgggaaaagaaatggcacacttgaacgaagccttaactacttcggaagttattctgaatatagataaagcatacgtgcagttagtgaaagccaaggaaatgagaaaagtggcggaaaaatatcataacttactaacggaacttttcaaaaatgtgaagagtgctcaccgacatggcatgaaaccgcaaaatgatgtactgaaagtgcaggtgaagctcaacgagagtgaactttctttgcgaaaggctgataacgccctccgtcttgcgggtatgaatctctgtcattacatcggacgccctttgacagcacagattgatatatctgatgattttccggaagtggagcaggaatggaaagtgcaggttgctgatattaccgcccgtcccgaatatggaatcttgaacaaacaaatagccattgccgagcaggaggtaaagctgaatcgtagtgaactgttaccgcgtgtcggcgtcagaggtagttatgattaccttcacggattagaagttaatgatgaaactttgatgaaaaagggggctttctccgtattcctgaatgtctctgtccctctgtttcattttggcgagcgtaccaataaggtaaagtctgccagagtgaagttggaacaagttcgtcttgaacaggaaaatgccaatgaaaagatgttgttagagttgatgcaagctgccaataatctggatgaggcccggctggaaacggaactttccgaacgttcgttggaacaggcagaggagaatatgaaagtcagtggtaagcaatatgaagtgggactggaaactctttcggattatctggaagcgcaagtgctctggcaacaggcttatcagacgaaagtggatgctcattttcaattgtatgtgaattatgtggcttatttaaaagcggcaggacaactgtaatgataaaaccagtattctggacatccttatggaatgtccagaatactggtgatgatttgtacctgccggggagtaaacgttcgtgtacgcggatgataacctgtggcagtcaatagccggagcagttctttatttattttaatccatttggtgaatatgcgtatggcgcaacggggtgtaatgtttggattgtacatacaagccaattcctttttcttataagttttaatgcgaaacggaatttcttcctcttctgatggcaattctttcatgttgatattttaatgttttaagatgtggtaaagatacaaaataaaaaaggcgttgtcaagtcttttacaggaatactttgggaaacagtatccgcccgtaggcgggtactgttttcctgcttttaaaggctgatgattaatcttatgctgccgggtccggtgcttctcctttgccgtcatccgggttgggggccggttgttccgggctgatggaaccatcatcggaagctaccgctttttgaacactgactttacttagcatctctttgaatttgtagcccggagtgaaaatgattttcactctgcgtatcgtatcgctatctacctctttttcagtatcctgactttcgcaattcatacctggacggaagcatccgaaatctcctaattgaacagagatgccttttctaaggttgagattcaatgtatcgatcaaagcatcgagtacaaattttaccgctccactgggaaccattcctactttagtgatttcctcgcacaaatctctgaaatccaccgtattggtgattacattttgtgctacatacttttcagctttagttttatcaaagccgaatgttctttttttaatgacgtatctaagtgccatagttttttgttttttttaattagttactttacttatcaattctctttgtgatcacgatgcaaagatactatgggcactttccggggaggtgctttaacgatcctagatgtacgtactttgattcacttttatttattttgtttgtatgattctgatttatagattcttagatgttctactttaatagccatttccaaatagggagtatttcaatcagtttcacgatactcaaatgttcttgataatcataaaatatgccgaaaaacgatgaacgttgcaagaataaacactatatttgtacatattacactaagataatagaggtatagtatgctacattcaagccaatcagcccccgttgttgatggcaaagtcatggagtttgtgatttttgccattgagagtgccgcccagaagttgggtattccggctcctactctctataaccgtttggaaaaactgaatcttatccgtcaatacctgataagtggatatgacatgcttcacacccagagtcgtgagtacatagccgatacgttggtagaagctcttgaaaactgggaagcccattataaagaaaaaggagaatctgtatgaaggtctatcatggtagtacgcaggccgtagagtatcctttggtcggtgtcggacgcgaaaacctcgactttggtaaaggattctcaatcaacgtctcattgacgagtgtctctctttcaaagaatatataacaataaaataaactgcgtttatgatagatgtattagtatggaataaatacactcgtgtggtgatgcaattagcggagcgtttgaatatttctcccgaaaaagcattgcacttgttctataatagtaaggtatatgcattgcttcttaataaacaatatccgcttataacgttgagtgatgcctacatcactgatgaaatcatacttgagttacaacagcaataatcttgttgtggctcttaattctgtgttccaagagtttatacctttatatatacagtcaactttccaaccccttccttttggattattctgtcggtaataaaggaatttaattcttcaatagctacttttttatttcgtcctgtcagatggctataatctgtccggctgatgaataggtgattttccaaatatgtgttgaggcgctcgcgacacgtctcacgggagatactatttttcttagggcgtgtgatagattctcctcgttgcagcctcattttgtcgcctacttctttcttgaatggacgacttgcgcggaaattaatatttttcatttggacagacgctgcccgaatttcttttttatctttaaccggcggacattgcaacgatgtagagaagaatccgaagtttcccatttctacattccagccgtcggctagtaaatcccgtgcttcattggcaaaggcttccatggctcctgccaataaacttctgctgataccggtaaatttgtggacacgatccagaaactcttctttatctacggttcctttggagacaatacgggcatgtagcggttgtttctctccgtcaggtgacggtggattttcaaataagtcatataaagcactcatattctattattaatggattaattactactattaattcgttctaccaaggttattctttagttctaccttggttatcgtttggttcgaccatggtatttgtttagttctacctaggtggaacgaattgttatttgctacaaaagtaggtagtttatgtaagagagaggtgctttaattgtagagtggtttcttatttgaataagataacttcgttataacttgcacttcctgatttattcaattacttttgtagcgtataaacccaaagaaaggagttgtataagtatggcaagaccaattaaggaaactccgatacttttcggagaagatgctcggcgatttgaagaacggatgaaagagaagcgtagtgaaacgccggagcagcgggaaaaaaggttgaaagactatgaactggcaatgaaaatctttaaaaaataaaatacgaaccttttctttatcgggaagctttgttagctgtaagtaatgtacttgaaaataaaacgggttgtcgctttttaactgtagatgcgtatgcagcagctgttcctttttatgagaaaaatgggtttattcctttgaataatgaagatgtggattctgctacacgtttgctttattttgacttgaatgatattgtgctctagattagagcagctttattaaatattttgttttgtatacgagacaaaatggtgtgccccttattttatatacgaaacaaaaaacttattgaaacctgccttttttatatacatacgttttaattatacaatcatcattcgttttctttcctaaacatttatacctctctcttgttattttccgaaaagtatttgtacctttgtcattggaacgtagtatgcctttgtggtatgcgattgtgcgtttcctcggtgaacaggaaatcgtagcggattttttttcagacaccgggagacgcctgtacttctatgacttctcatagggtacgggctgtctgcccgtgtctgaaaggtagccgctactacctcctgtttgcgggattgtggcagctccgtactcttttataataaaaggtacggaactagttgatattattaatctagttccgtttttttatgtcaaattggctcacaacaaaacagatgtctgaaagacgcgacattcaagaagctattctaaagaattgggcaaatcttggatacattacgagttcccgaatcgacgatcagttgtttttggatgatgagagtttggatgcttatctggaagctcacaaaagacttggtttagaagcaggttacctttctaaaatcgtagaagaaaagaaactggaacgggactttatcatttccaaatacgatgatctactatatgtattgagaacacagacgacttgtaaaccgctatatgaaataatcattcgtgaactgtcagcattgattcttcaccctgttacccgcgatatcttctattcaatttctacaggagaatcagtagcgaaagtggctgatcggcatcgaattacctatgggaagacattgcaaatgtataactctatacttaaagggttgaaactgaaaaaagatatattggctacttatcgaaagcgtgctatcgatgctcgttttttatccttggtagacaataataagaatataaatgttgggcaggaggagtggatacttcaattgcctgtttgtaaagtagctgatacccggttggctaatatcttgtataatcaagatgttcgaacggtgaaagatttgttggatatagtatcgggaagaggttggaaaagtctgttgagaatagaaggagtaggaaaaacttcctactatcatttattatccaaacttcagatgataggtgttgtggatgaaagtctggatcggattcttgccggatgctctaatggtaagttcgataataaatgacgggtaggacataattatggaaagagagatgatataaagaggttattttaaaggaaagatagaaatttcaacttctaaaatagcctccttatattatatatgtatgaacatacggtctatctctctgcctctattgtataagtaaagctgtctgcccgataatacccgacgttgtattcaataggtactccgttcacatcataaacaaatcttctccttattaatatagggtcattggattttatctccagtttctctgcaataaattcccctgcaagtctggctgaaatctcctccttgctggtctttaccactatattatattgggtttccagcatttcgtataatgggcgtgtataatcttcctctccggttagtggaatattggggttgaaataagagatgaagtaaacaaacggatattctttttttcctctgacacgctccatcactacacagcgagtgtcgggattggaacctaaatcaaagaatgtgccgatttcttcggttggacgctttaaactgatatgcagctcgaaattgcgaatctcgatacctaacatcttcatctcctgtgagaaactaagccagttctttactccgcctacgatacctttctttactaccttcgttccgtaacctttctttcgcaccaaaagcccctcaaacacgagtttgttgatagcttgtcttaatgtgttccttgaaatgtgtaattgttcagacaattcgacctcgttgggaaatagcttcccgtttttgtactcttcagattctatgagtcttcttagtatctcttctgcctgaatatgaagcggtttatcactattatgatctaatttcatatctattctgattggtttattttcagcaaatataagatttatcaaaaaataatccaagttttgtttggaataaaaataaaatctatatatttgcacaattgaaagtatgtatgaacatatagaatttaaaaacgctataaacatgagaaaagctaattatgataaatttccttctacgaagctgacggggatgcttgttcagggttgggatagtatcatttctatgttaaaaaagaaaatggatgcaagaaaagtgctggctgtggatttatatacaggagtatatgaagaagaagtgctggatgctttttcaaaagaattctccggaagagtgatgaatgtacgtgatttgatgaaaccggaaaaagaaattcaaacgttgacagaacgcttcatgactgaagatgtgttattcggctatgttaccaatttgaagctggaagattatttggatgcggataaggtggctgctgcacggaagcaaatcagtgaagcgaaagaaaccattgtaatcataggtacgggagctgctgttgttgctccgcaggacgcgatggtagtttatgcggatatggcacgttgggaaatccaacaacgtttccgccggcatgaggtaaaagctttaggtatagacaatcggaacgatgctgtttctttgcaatacaagagagggtatttcaacgattggagagtatgtgataggtataaggaaagattgtttgacagggtagaattctggattgacacccatgtggccgggacaccgaagatgattgataaggatactttctttaaaggggtagaggcaacggtgaacacaccgttccgggtagttcctttcttcgatccggctccctggggtggtcaatggatgaaagaggtttgcgacctggatcgtgaacgcgaaaatttcggctggtgctttgactgtgtacctgaagagaacagcctttattttgaagtgaacggagtacgctttgagctgccttcggttgatttggttttactgaaaagtaaagagttgcttggtgaaccggtggaggcacgctttggaaaagacttccctattcgtttcgactttttggatacgatgggcggaggtaatttgagtttgcaggtgcatcctactactcaatttatccgcgacagcttcggtatgtactacacacaggatgaaagttactacatggtagatgcgggagaagatgccgtagtttatctgggagtgaagacacgagtggacaaagaagcgatgatcggcgatttgcgtaaagcacaaaaaggtgaattggtgttcgacgcagaaaagtacgtaaataagattccgacaaagaaacacgatcacttcctgattccgggaggaactgttcattgttccggtgccaacagtatggtgcttgaaatcagctcgactccgaacctcttcactttcaaactatgggactggcaacgcttgggactggatggaaaaccgcgtccgatcaatgtggaacgtggtaaatgcgttatcaactggaatcgcgatacggaatatgtaaatgaacaccttcgcaatcagtttaaggaagtcgcttccggagaaggctgggtagaagaacgtactggattgcatccgaacgaatttatcgaaacccgccgtcaccgtttctcatcaccggtattgcatcatacaaacgatagtgtaaatgtactgaatctgctggagggagaagaggccgttgttgagagtcctactcatgcctttgaacctttcgtggtgcattatgccgaaacatttatcattcccgccggggtgaaagaatataccattgccccgtatggtaaatctgcaggaaaagaatgtgtaacgatcaaagcttacgtacgcttttaataatgaaataaatcatctaatatcttgagaactatgtatgaacatgatgaacgaatcgtaatgacgctcgatgcgggaggcactaatttcgtgttttcagccatacaaggctgtcgcgaaatagtggaacctatttgccttccggcagcgtccgacgacttggagcgttgcttgtctgttcttgtagaaggtttcctggaagttgagaaacgattgccgaaacttccggtagctatcagttttgctttccccgggcctgctgactatgagcatggaattattggtgacttgcctaacttcccggccttcaggggaggagtggcacttggaccttatttgagggaacagtttggtattccggtttttattaataatgacggtaatttgtttgcttatggcgaagccttggcaggcactttgcccgaagtgaataaacgcctgaaagaagcaggcagcagtaaggtatataagaacctgctcggaattacactgggtacagggtttggtgccggagtggtgattgacagccggttactgaccggagacaacggttgcggcggcgacgtctggattatgcggaataagaaatatcccgaaatgatcgcggaagaaagtgtcagcatcagggctgtcaggcgagtatatcaggaattgaccggaaaggatgcttcttctttaactcccaaagatatatatgatattgccgaagggactgcagagggagatcagcaggctgctgtccggagttttaacgaactgggagagatggccggtgatgctatcatccgtgcattgaatattgttgatggcttggtagtgattggcggaggagtggcaggagcggctaaatacatacttccgggaattatgaatgagatgaatcggcagattggcacgtttgcaggagcttctttcccttgtttgcagatggaggtgttcaatctgtccgaaaaagaggcatttgataaatttctggaggaaaaagacaagatggtgaaaataccattttcggagagagaggtgcattatgcctgtcacaagaaaataggcattgctgtttctacattaggagcaagcagagccgttgctttaggggcttattcctttgctttgtcccaacttaatatcttataatatatgataactcttctattaattcaaatataaaatgttatgaaacaatctaatctattgaacgcgcaatttgcccgccggcttttcagaacggcattttcgagttggcaattattggctgttatgttgattgtttgtatgaatgtggctgttggttccaaactgtatgcgcaatctaatacaatcgcagtgaaaggtaaggtaatggcagacggggaacccgtgattggggctaccgtgctggtgaaaggtgtatctacgggtacggctacggatatggatggaaatttttcactgaatgttgcttcgaaagcggtattggtagtttcctcaattggatatgaaacacaggaagttccggtgaacggccgccagtttatcaatgtggtgttgaagtcggatgtggttgctttgaaagatgtagtagtggtaggctacggcgtgcagaagaaagtcaacctgacaggagctgtgtcttctgtttctacggatgaattggaaggaaagccgatttccaatgtattggaagcaatgcagggaacgactcccggtttggttattcagcagggaagttctactccgggtagtgtaccttctattaatatccgtggtttgaatacaatgaacaacaatgatccgttggtgattattgacggaattgaaggatcgctcgccaatctgaatccggctgatattgagcagatttctattttgaaagatgcttcttctactgctatttatggttcacgtgcttccaatggtgtggtacttgtcactaccaagaaaggaaaagccggtaaggtagaaatctcttatgattttatgtatggtgttcagcaacctacttcattgcctaagatagcagactcgtgggtatatgctgaactgtataatgaagcggctgtcaattcgggaagagctgcaaaattcactcccgagcagattgcgcaatttagaaatggcggtccgaatgtaaattgggtgaaagaactgtatcaccgtaattctcctcaaagttcacacaatgtttcgatgacaggaggtaacgaccagttgtcttacatggcttctttgggttatatggatcagaacagtatgttcaagggacctgattatggttataaacgctacaatgcacgtctgaatgtaagccataaggtgacgaataactttacattgaatttgacttctcaatttgcccgtaatgatattaaagaacatgcttactggacggaatggattatcgagcaggcaaaccgcatgccaccgatttatccgatcaagaatgaggatggcagttataattatcctgccggaagtaactcaaacggtttgcagcgtttggaagaaggcggttatcgccagaatgtgaatgatgaattattgggaaccatacaagccgaatgggaagtatataaaggactgaaactgatcggaagtgccggtggacgtgtttggaataataatttgcatgagaaccggaaggccttcgaaggtacgggagatagtgaaaataagttgaccgagcaattctatcgttctaagaatatcactaccaatcttatggtgacttataatacgaaaatagggaaacactctatcggtggattattaggatatgcttatgagggcttctctgaaaagcagttctctactagtcgtttgacggaggattctaaatatgatatttttgtaggtgatttgagtggggataaagttagcaatggtggttcggcaagtgactgggctatctattccggttttgcaagagccacttataattatgatgagaaatatctgctggaatttaatatccgtaatgactattcttcttattttgcgaaaggaaaccgttcgggagtctttccgtctttctcggcaggatggcgtatctcggaagaaaaattctggtctgtactgaaaccgtatgttccttctctaaaaatcagaggttcctggggattggttggtaataaccgcattggtgcctatcaatacatgcagacggtgtctgtgactaacggcatcagcttcggagataaattggcgcagacggctacatttgcttctacaaatcctgatctcaaatgggaaactacccgtatggctaatatcggcttcgaattgggattgttgaataatgatttgaatataacttttgattgtttcaataatcgtacaaaagatattttggtaaatttaccggttcccggattgtttggtaatggtgccccgattcagaatgctggtaaggtagagacgagaggatgggaattatcagtaagttatcgtttgaagaccggtccggtagtgcataacttcgccggaaatatttcagatagctttaatgaagtaatagatacacgcggtacggaaattatcggtggctcggatgtacagacaattatcaaggaaggttatccgttgtactcttactatgcatatcgttcggatggatttttccagaatgaggaagaatgtcagaaaggaccgcacttggaaggtattacaccgaaaccgggagatattcgttatttggataagaacggtgatggtgtgattaaaccggacgatgaccgttttattgttggtaatgacttcccaagatatactttcggcttcacctatggtttggaatataaaggttttgatttctcgatgatgtggcaaggagtaggaaaacgtaacaagtggatgcgtggtgaatctgtagaggctttccataataacaatgaaggtcctgtaatggatttccatcaagatcgctggactccgaataatccggatgctacttatcctcgtctgacaatgggtgcggaatctgctaataatgcagcgaaatcagatttctggatccaggatgctaaatacttgcgtttgaaaaatgcgcagatcggatatactttcccgcaacaatggatgaaaaaactctatgtcaagaatttaagaatctttgccagtgtgcagaatccgttgactttcacgaagatgaaaggcggatgggacccggaatataccggagacggtagtggtcgttcttatcctgtggcaagagtatattcatttggacttaatgttaaattttaaactgtaccgtgatgaaaacaactataaagaatttgattttatctgctgtcttggtagtgggcggtgcctcttgtgttgacttggatacggcaccgtatgacagagaaacggacttgacttattgggaagaggatcctgaagcagctgtcaaggcgttgaatacttgctatacctatttgggaaatatggacgaacagctttattgtgaagcaatgacggacaatgcttataccaagcaacctaatgattttacacaaaatattggtaatggttcatattctacagccgactcttacgtgaaacaggtttgggacgggcgctatacgggtattcgtatgtgtaaccagttgctggaaaatatagacagggttcctgatttggacccggaattgaagaaacgttatattggtgaggcaaaagtacttcgtgcttatagttattatgagttgtatacgaaattcggcgatataccttatactacaaaagtgctttctatcaaagaaagtatgtctattgcacgtacagccaaagccactgtaatagcaaatgttttggccgatctggatgaagtgattaacggtaactatttgccgacttcttatgatgcggataataaaggccggattacccgttgggcggcaatggcgattaaagctaaaatctatttgtttgaaggtaattggacgcaagtgaaaaatatcacttctaccattatgacagagggaggctttaaactctttggaagttacgcgggattgtttgagattgctaatgaatacaactctgaagtaattttggatgcacagtatcgtccgactagtcgtgaacatcagatgatgtatgttttcctgccgcccactttgggtggatattcccagctttctcctttgcaggagttggtagacagttatattatgctggatggaaaaacaattaaggaaacaggaacatcgtttgatgaaagtcatccgtatgccaatcgtgacccacgtttgaaggcaacggtgatgtacactggaaactcatatacgttggccgacggaacagaagttgttatcaactgtgagaaaggtgaaggcaaagatggttatggagtaggttcagactgttcggctaccggttactatattaagaaatattgggataacacttatcgtgctactctttattctggtttgaatccgattctgattcgttatgctgatattttattgatgaatgcggaagcattggcagaattaggagaactggataagacggcttgggatgcaactattaaaccaattcgtgatagggccggatttacacttgcttcagcactggaattcccggaaggagcttctaaagataaactgattgagattgtacgaaacgaacgtcgttcggaattggcattggaaggacatcgccataaagatattatccgttggagaattgcggacaatgtattgaatggatggtgtcacggattaaagacaaatgatgtggtaggtacggatgatggatacgttcgggttgaaaacagaacctttaatgcaaataaacattatttgtggcctataccacaggctgaacgtgacttgaatggtaatttggagcagaatccgaattggtaattggttaaacgactcaaaaaggaataattatgaaaaagatattatggatatgttcagcacttctggcaatggtatcatgtcaggaagattatgaattgaacacggattttgcagtccccacggaattaagttcccctgcttctatccagttgaatgtgtcatctccaacgcctgttgtgttgtcgtggtcaggaggtggtgcggcagatggcggaattgtattgtacgaggtgctgtttgataaggcagacggtgatttttcaaagccgctggctacggtgaaaagtgatttgggagctgcgaccagtttgtcaatcactcatgcagctattaatacgattgctagaaatgcaggcatttatcctttggaaaccggagatataaaatggacggtaaatgcttcgaaaggtggagtggtgaagagaaccgacaaggtggctaccatcacagtaactcgtggagagggaattgataatattccggctgaattgtatttatatggttcggctacggagaacagtggacagggtggaattccgttccgttgtgtagaagagggcgttttccagatttatacgaagttatcagcaggaaatatatcatttaagtctgctactacaggtgaaacattcagctattatattgatgatagctcgaagttaagagaaggggagggcgaaacggctgtaactgcttccgaagaagtaacccgtctgacagtgaactttaatacaatggcaatgaccacggaaaaaatcggttcttctgttcgttgtatttggggagcaacatttggagatatagctgtattagagtatgcgggtgatggtaaatttgtgggagagggtgatatccgattccttgatccgtccaaaccggaaaccggtgctcctgattggttaagttggatagaagaacgttactactttttagcaaaagtaaatggtggtgatatgtgttggggtagaggtgatggcgtgagtgccgaacgtccggtaggtggagaacctgcttctttctatgctttgtatgaattccaatggagtcagtgggatcatctttggaaaatgaaaggtagtctggattatacgcatgcaactatcactatcgatacgaattcggatggattgatgatacatacatttactaatgtgactccgattaattaataaaactaagttatgaaaaagataaagactattttagctattcttccggcactattattctcctgtgccggagatgacgtagagaaatatatcccgcctacaccgattgctccgtcagaacccggagaggaggtcgtttatcataaacgtgccaaagagcagtttgacttgattaatcagtgctaccggatcaatagtggggcaacagaaggactgtataatgaaaattatcctaagaaagacggggataattccgcttctttcttgtggccgtatgacggactggtttccggagcagcagctttgcatgctttaggttatgatgtgaattatgcggatatggtagaccggtttgaagtttattatcgtactcctaatggaactgtgggtggttatggctctcaaaccaatggtactaccggtagtggaacacgtttttatgatgataattctattgtggggattgaactggtagaggcttttaatttgctaaataatcaagattatgtgacgaaagctaaaagaatcgttgagttcctgcaagctggtgaagatgatacgtttggaggaggcctttggtggaatgaagagcagaaagggcagcagggagttggtgattcgaataaaccgacatgcgctaatggatatgcaacgctattcttgcttgaatattattctgtatgtcctcaagaggaaaaagcggatgtgttggctctggcaaaacgtttatatgcttggacgttgactaacttgcgtgatccggaagatggctgttactggaatgataaacaagcagacggatccattaataaaacaaaatggacttacaatacaggtgtgatgatttctaacggaatccgtttatacaaaataacgggtgagcagacttatctggacagtgccattgcttcttccgaaggtgcgtataattattttgtacgtccgcttaatgggttggcgttggcttatcccgatcatgatccttggttcacaacaaaactgatccgtgcatttattgatattgagccttattataaaaatgcaggcaattatatcaaaacattcatcaacttcctggattatgcatacgaaaatgcccgtttatcaaacggactgttctatgaagactggacaggagcaactccaaaacgtgctgaacagttgttgatgcaggatgctgcgctcgaatctttgggaatgattgctttgtacaaaggagaaacagtgacagaggaataggatatgaatagtaaaattagaaatatagctttatttgtatcgacggtattcgtgcttctttcttgtgccggagaatcaaaaacgactccgaataaagataaggcagaagaaatgtttcagcgtgtttgggaactctacagggttcccaaatacggcctcttctctgaatattacccaagcagtcatcgtcctgatctgacttattttaatgattccacccggcaagcgcaggaagtttcttatctgtggcctatgagtggtgtcttttcttcggcagtgttgatggctaccatcgaaccggagaaatatacggtttatgtcgattcgatggtgatggcgatggagcgttactatgatacaacgcgtgttccttttggttatcaggcttaccctgttcagtttggaaaggtagaccgctattatgatgacaatggtttagtgggtattgattatattgattcttacctggtaactaaaaattctcattatctggagaaagcgaaacaggtattgacctttattttaagtggctgggatgagaactttgaaggagctgtttcttggttggaaggagtgaaagatcagaaacctgcctgttctaacggaaaagcgatggtgttggctttaaaactttatgaagcaactaaagatgagtattatctggaggtgggaaagaagttctatcattggattgataaatatctgaaagatccggaaagaggagtcgtttggaattcatggttaacaacgacttcggcagtatgcccggatttgtatacttacaatactggtactttgttacaagcagctgtagctttatataattatacgggtgagcaggcgtatctggataatgctaaatttctggcagaaggaagttgcaaagtgttctttaaatacacggaagaaggtattccctatattgctgatttaccttggtttaatctggttttgtttagaggttatcacgatctgtacaatgttacgggggattcaaagtatgtggatacgatgataaaaggactggattatgcttgggaacatgcacgtgaccaggcgggactgatgtatcatgactggacagggcggactgatgaaaaacgtaagccgaaatggttattggatgcttcgtgtgtgccggagtattatgcacgtgtggcgatgattaaaggagaagttacaaacagaaaaataaataaatgatgaaattaaaatggataggtagcctgttgattctggcaggtgttgtagggtgcaaaacacctgatcgtcccaatctggtagagtatgtgaatcctaatattggaactgtacatagtcgttggtttttctatactccggctgcggagccttttggaatggctaaactgggagcttctaccaatggaacttacggtaataatcaaggatgggaagctattggttatgaagataatcatacttcgattgatggctttccttgcttacatgagtttcagataggaggaatttcactgatgcctgtaacgggagaagtaaaaacaaatcccggaaaactggaagaccccgataaaggtttccgttcccgctttgataagaaagatgaaacggcgcgtccgggatattactctgtattattaaaggattaccaggtaaaggcagaacttactgccactgctcgtgtcggattccagcgatatactttcccggagacggaagctgctcatattcttttgaatattggaaatcgtcagggagaaagtggagctgtgcgtgatgcatatatcaaacagatagatggaaatactattgaaggttacgtgattacggaaccggaatatgtgaagaaatatcaagcgggttcatcagtagctatgtatttttatgcaaaactagatcgtattcctgaatcggtagaggttttttatcaagatagtactctgaaagcgggaaatgaaatcaaaggtgcaggagctattatgtgcctgaattataaaacgaaaaaagatgatgtagtaaatgtaaagatcggtttgtcatatacttccattgaaaatgctaaactgaatctggaaacggaagcgaaagacttgatttttaatgaagctttacagtcaactacggataaatggaatgaatccttgggacgtattctggtttcaggaggtacggatgaaagcaaaatcaaattttatacaggattgtatcacgctttgttgggcagaggacttgctagcgatgttaatggagcttatcccaaaaatgatggaacagtagggcagatacctttgggaaaagaaggtaagccgatatataatcattataatacggatgcagtttggggggcttactggaacttgacttctctttgggcactagcttatccggaatactacaatggattagttaacagtcagttgctggtatacaaagatgctggctggttaggtgatggtattgctgccagtagatatgtttcgggcgtagggacaaatatggtgagtattaccctggcaggtgcatacaatagtggtattcgtgattttgatgttgaaacggcttatcaggcagctttaaagaatgaattaggctgggaaggccgcattgagggggcaggtaagatggatgtgaagcagtttgtagaaagaggatatgtaccttatgagaacagtgttcattatggcacacatccggatggctctaccttttctgtttctcatacattggaatattgctttagtgcttatgctgtggcgcagtgggcgaaagcattggggcatacggatgattacaaccgtttgatggaattatcaagaggatgggaaaaactatttgatgattcattgaaactggttcgtcccagagttcctaacggtgagtttattgataactttaatccgctggagtcatggagaggatttcaggaaggaaatgctgtacaatatacattttttgttcctcaacatccatatcgtttgattgaaaaagtgggtaaagaggaggttaataatcggttggattctatatttaccgaagcgcgtaaatctatttttggtggcggtaagataacttatgcttttgcaggtgtggagagtccttacaatcatggtaatcagccaagtcttcatattccttggttgttcaatttctccggtaaaccttacctgacacagaaatggacgcgcttgatttgtgatgagttttacggaacaaacggagagcatggttatggctacggtcaggatgaagatcagggacagttgggagcctggtatgtgatggcggcaatgggattgttcgatgtacagggcggttcttgtgaacgaccgactttccagattggcagtccgttgtttgataagattgaaatcaaacttagtccgatgaatgcgacgggaaaaacgtttgtgattgaaacgactggtaatacaccggatgcctattatgtacaatctgctacgttgaacggtaaaccgctggaacaatgttggatgtaccgggatgaactctataaaggtggaacattgaaactcacaatgggtaatcaaccgaatgaaaaatggggagtggaaaatccgcctcattgttctgaataaacagcttatttacctcggtgccgatgtcgcttgacaatggcaccggggattctacattttataatatagtgagttaaacatgaaaacacaaaactctatttatgccgcccttcccgttctcttcgggttctttgtaatgggcttctgtgatatagtcggcatttcgtccgattatgttcaacgtactttcaactggtctcctgtgatgacgggatttgttccttcattagtatttatctggttcctgtttttaggtattcctattggaaatcagatgaacaaatggggacgtaaaaatacagttcttcttagtatgggaataacggtagtgggtatgttattaccattgatcgtttataatagcgcgacttgtatgatagcttatgctctcttgggaattggtaacgctattctgcaagtttcactgaatccgttgttaagtaatgtggtaactagccaacgtttattgactagtagcttgacggcagggcaggtaatcaaagctgtatcttctctcgttggaccggagattgtattgttggctgtagctcactttggagacgacaaatggtattattgcttcccgatattaggttttatcacattattatccgctgtttggttgatggctacccctgttaagcgagaagattccagtgctgcaacccagcaactttctatcagtgatactttttctttattgaaggataaaacgattctgttgttgtttttgggtatcttctttattgtgggggtagatgttgccaccaactttatcagttctaagctgatggcagaacgttttgactggacgacagaacaagtgaagtttgctccacaagtttattttttaagtcgtacggtaggtgctttattgggtgctttcttgttggcccgtatcgctgaaataaaatatttccgtgtgaatattgttgcctgtattttctctttgcttattctggcctttgtgaaaaacgatatggtaaatctgatttgtatcggtgctgtcggtttctttgcgtcatccgtattttctatcatttattcgatggctttgcaggcaagaccggaaaaagcaaaccaaatttcagggttgatgattactgctgttgccggtggcggagtagttactccagttattgggtttgcgattggaacagtaggtgttatcggaggcgtttttgtcactttagcttgtgtgtgttatttgacttattgtgcttttggggtgaagaccgcgaaagcctagtattattgcggagaagatgctatcttcgcccgaatcctacttagcgactgcggagttatccacaagtaagacgcaatatgttttaaaggtacatattgcaataattccggagtctctttgataaggttgagatagcgttctttagcccgtgggcttcccgagctgataagccagttctcctgttgaagaaactgatgatccatgaggcggagccccaaattagcgagtccgatggatgaggcgaatagctgattcagagctgttcgggaaatacaataggccacactgtcacacatgacctcaatatttattaatgagtaggcattatctacatagccccagacggagaaagcagcttctccgtctgaagcaaaccagatggtagtatccactccgtctttatgataataggctcgccatattcctgtcttgataaaataaagattacagttctttgtcccttcgcgtactattaaatctctttttttgaaatgtacctcttccatatagttcagtagagactgtacatcggtttcagataccttgtatctatcgcaaagtttttcaatgaatgttctcatattgcaaagatacttatcgtcggcagacaatgaaacgatctttcaaataaattccgaaaatatagaaagtggttaataactctgccaatggtacggctagccagatacccggtatacccaataccggagggagcgcaaagaatcccatcaacataaatacgactccccggagaagagtgataattgttgctcgctgacctctttcgacactctgataataaccaatgccaatcatgttgacggcaaagaaaatgaatcctactccgaaataaggaagcccgtttactgctatatcaaatgcagcgtagctgcggtcaatgaataacgaaacgatgtcttggcagcatagtacggtaagaatgaaaaagctgataccgcagattaaagcggtccgaatggcgagatgcagtgtctttcgtacacgctcgggttgtccggctccgaagttatagctgataatcggctgtgcggattgtgcaatggcattatagaccatgaagatgatagggaagaagtaacaggcaatactgaatgctgccactccgtcttcaccgagatggcggatgaaaacgtagttccccagaaacatcatacaggcaatggaggcttcactgataaaagcagaacttcccagtttaatcatataaccgatgttgcgaagagtcagtaacagacttttgatacttaactttatccggcatagatggagggtacgagagaaacggagtaagtaaatcagtgtcatcaaccctcccacgacagttcccagactggtggcaaaagctgctcccattattccccaaccaagttcgaagatgaatatataatccagtatgatattgagtatggctgcaaccgcattacacatcatggtataggtgggtgaaccgtccagacggatgcagaacatacctatatttaagacttcgtagaatacgagaaaaggaatgtaccatgccatatattctacagctaacggcaacaatcggtccgaactacctaataatctggctaatggctctataaaataaaggcacagagcagacaggataagtatgagcaatgcggaaaaagcaattgcctgagtgatattaatacttgctactttgcgttttccctgagataaatgaatggaagccaccaccgaagctcccactccgaacatcagtccgatacccgctgcgatcataaaaagcggtgcagtgatatttactgccgccagcgcgtcactgccaattccttttcctacaaatatcccgtccgtaataacgaacagagccgagaataccatcccaagtaccgtaggaattagtaacttacggaacaacgtggagatgttcatactgccgaaatcaatactatctttcataactttctacctttgtcgttgaaaatggcgacaaaggtagggttatgggaggagataaaaattaccatttggtaatttttatctctatatttaatagggaaaagaatctcttatgtatattctatcaattatttgagcatgttgaaatcctttattccaaaaacttcagtggatatttcacccaaccaaccgcttttactattaacacccacttgtactttgataaaatcaacgtacttcaggtttgcatccttaccgtcgaaagttacagcatgggatatcttgaaatgattgtcagacggtccggcattatagttgtcatcatctgtcagacgatcaatggcgctgaaattatcagcatatccccattcataactatcatttacccaataagtaccattaccggattgatcgtaattacgctctttcaggcgagtacctcgcaaagtatattgtttttcctttacccaggcgggataataataatcttgccggtgaaaagcacccagataatcaatagacccactttgaccatgattgtctgtccatggggtgggaagctgaataccagttggtttatgataggtgacggcatagtcctgccaggtttcggctttcccatattcggatccgcgcaattcataccaagtgtcattaggtaacccatcaccattttcgtcctgcattacccatacaattcccggttctgacgaaccatcaaaagcgtttcctgtaatagcaatgttgtaatctccatcattcacgatactatgatcgaatccaacgatgatgtatccaccgaatccgcctagggaaacataagccgtctgattgattcgttcttctgcataggtgcaggcttctgccatagttattgtgttatgattctcattgatgaattgaccgggagccggtaaatattcatatactttgttcattgacgcagaacttgtggcgctaatcttccgctggtatgttcctgcgggagggcaaacattgacttttaatgtttgcgtagcgagtatatatgagttcttcatttcgacctttaccgtgtgttctccctgctgctcggatgtaaacagataagtatcattttctccggattgcacttgttcattgtccacggtccatgtatagactgcatccagtgcattattcacgtcaaccggtttgatacggatagttctgccggctgacatgttatattccgtttgcaggaatgtccagttgaaatctacttgatccggtgaacaaacttctactttgaaagttacttcgtcatcgccatcttcattgtgagtagcaaaacgaacttgatattcgccaagctcgattgtggggagagtacaggttaattcgttcgaaatatcttcaccgtttatttgccaggagtaactggtttccagaaaagaatctactataggtgtaatggttagttcagagccttgaagcactttgaaacctttgtcggcatccgcaatagagatagtaggtacatcaagttgaaagacatcgatacgtatctccttttctgttgtccctccggcattggtggcagaaatcagaatgaaatacctgcctgcttcatcggctgaaaatgtcagggtggaagtggtacagatactctttccatctattgtccagttaaaggtcgtttccgaatcggtattttcataaatgggagcgatggttatctcccgaccaatttttgttttatagatggaggattcttctttcaaggtaatgacaggagcggaaagaagaggagagtcctcctcttctttcacgcatgatattaatgctaacagaacaaataaaaaaagtataatatgtttcattagaatctcactgctacatcatcataagcaaaataggcaggttggctgaaaccatatccgttatcattacttccagtgacattaaagtctattttgaccactttgcctaatgcggataaatcccattttgtccattcaagtatattaccctcggctccaaccaaataaaattccggacgtgtagctacttcttttccatcttcatcataaccgatagcaaccagtttcacccaatcatctttgcctgcgggtgcggtcaaaccgttaccgttggccacacagttggctaggtaggtcgtcatagtcacatacatgtggtcaactacacgagcaactccgtctccaaagtaaatatagggtaatggaccgttggcatatccggaattgtctgcatagccgtaatgtacgcagaagtttttggaaccattatgtcctccaaaaccagtttttgcatcctgataataaacggctagttggtgctggaagtctccatgagtaagatccatatccagataattggaaattgcgtgtccgccaccccagtattggtaatcaccccatccgttaggaagttcggaagcaagaaaagtgttgtttgcatcactccagttatagagttggttattcttaggataaagtagtgggccaccatattgttggctgtcaattaatgatgaccagtttctttctcctaccatgttagcatcacctttataatcaacatcctcgaatgtcaagaagtgtgcttcacgcactgctcttaattgcatttttattactttaccgaaagctttggacggagtgacaagtattttaagttcaccatctttgacatcatcacctgaaactgccggagctgtgattcttaagtctttatcattaagaaccgctgtccatccttgcggaatagcaattaatgttgcgtcgtctatattggcagttgtaagaagatacgtccttgtttcattagacgagaacaaggtataatccctattggcaatgtcaaatgtatatgtttcccctttgggcaatgtgaacgacgttccatctgcaagagtaactagtacatgattgtcattaactgtaacagatttgaagaaagagtctccgtcttgtccttccgctttcacaggttttccgtctgttccgttaatacgtttggctccttcgcctgtatcaacggtccagtatccgtcactatcaactcccataactggagttgtacctgtcacttttaacttgttagttgcatccggcagccattctgtagtaccgttggtagtaatggtccagtaatatattccgtcttcgtcagctttcactccaatcacaggagcatctgtaccattctttccatttttgatagatacggtgcttccatcactgaaggttaatgtgtagccatcagatgtctgttccgtgttggtgattactttcccttgatttaatgcgtctaccaaactctgtaaagttgtaatttcagagttcattttcttgactgttgtttctagtgtttctattcgtccgtcgagatcattgactttatcccagagatcatcgtcattgtagcaactgcatactgtaacgacagtgagcagtaaaaatagaattttcttcattgcttttgtttttaattattaatagaattgtgaattattgaatctcttttagtttcttatctgtaaaggcaatatgtgccggaatgtcccccgtgatgactgaccatttcttttttccatcccgggagaaacagtataatgtgccgggagtcacatagtctttggcatcggtgacgaagaattcacctgtttccggattgattgctattccataaggtatcttgatagatttttccgtaccatctgtaataaaattgcgggtatcagttttctttgtttttgtattatagatggcgtaagagactgtccaactgttggtgtaataactccattctgtactgtatacatacagtgaatctctgcaaatagccatttctgtattgggaagaagcggtaattcatcgactactttatcggtattggaatctattacaaatgtttcggagtaagtgtcataataatctccccgggatgagacataaatatttccgtattggtctaattccattctatgcaaattgattcccacatcaatggttttgataactttgaatgtgttcaagtcgatgacggataccgtgcggtcataattaggtacgcgatacccgccggagttggctacatagagtttgttgcccacaatcaccatttcttccggctggtagccgaccacacaggtatccttgacagtcagtgtggtagtgtcaacacgtgctacataccccagtctggcgttgggatctattttgacagggcctgcatacgaactgacgtatgcatatttatctttaaagacgatataacggcaattaggtatggaaatttgcgtgatgtgttttgctgtttctacattcatcacttctacgaaatgagaacagttgatgatggcatataacttatttccatagatttggatatcatttcccacatcccccaattcttgtacgactcccgggttccgttccgcatagatattcttatgatagataccggtttcgtaatcaaagtaatcaagggtagccttgttgcttcccatatttccttcattgagtagaaagaaacctttgacagaggtaccgtttactccgggagtaacttggttgggagttgacggaataatgcgttcatcttcgcgacaagaagtcgatagaagaacaaaacagataatgatggatagaacagatattctcataacatgacgtttaatttgattttaaaacttgtaccgggcataggatagcattgcactacttcatattgctgattgaagatattattaatttctgccgttacacgtattcccgttttcccccattgaaaagttttggatagggaaaaatcgtgggtataccagggctgtgcgtagttctccgggatattggcgactgcttcataacgttcacctgtataaatgaaactatagttacaggaccatgtttggtaacttccattgaggatgatggaacctccatgccaaggtatataaggaatctggcctccataccattcactggtaggatcggtaaaatcctgtgccttttgataggtgtaattgaagagagtgctaagttccacctttccgaagccccattctcctcgtatggctgcgtctaatccccgaatttccacatgtccgagattaatcatagtccaacggaactggttggaggtaggcatggcaatgattttatcatctacttcactatagtaaccatctatttgtaagtccaggcttttcagccaatggttattccaggtgtgagagaaagtgatacccacatcgtattgggtggtatattctggttttaagtccttattgcctataaaagtataatacaaatcattgagagttggcatgcgaaagactttcttataaaaggctcgtacattcagagggagcttggtcaatggttgccaggtggctatgacagacggagtgtatttgtttttggtgcctgcattggctcctttggtacgtgtattgtcgtcgacatgagtatataacaggctcgcctgcaacatgaggcggttgaagtcaaaggacgtggcagcagaagtcaggattgtattacgggttggatagacaaaatctatgagatcggcccgtaatgtattccattggaaatcgttggataatgacatactccaccagggatagatggtgaataaatgggcggccgaagcatagatttcttgctgtcggtagtaattgtctacgtacatggtggtgacatccagtctgggatcggataaatagtggagatagtcataagcatattttccgttggctagcagactgtaccaaggcttaaaatagttttgaaaagagccttgcacaaacagattggtatcccactgccggtcctgatggcgaaacttacccggctcttctcttaccgcagctccggggtatcctcgttctgaattgtataggtatgctttggctttccattctcctttggggatttttccgaagaatgcattctccaaacgtaacattcttacgtctccattttgacgaacagctgttgtgtcgtaaccatctttcttggcgtatgtgaatttatatcgtcctgatgtatacatatactccgtactgatggaactgcttattcgttcgttgaaacgatgttcccaaagtagtgacggattgatggtagagaatgaaccgcctttcaccccgatgttcaggttgtttttcttttcccctttgaataggggttttcgtgtctgcatatatatggcacttgcggaactataatctttggcaggttggaagatggcacttttttgaccattatatagtgaaatgacttccatattatctaatgaaaaacggcctagatcgacgactccattttgcgcatttcctaattcaataccatcgtagaatactccgacatgatgactgcccatacttcgtatattgacggtttttagtcctccaatacctccgtaatcttttatctgtactccggaaaagtagcgtaaagcatcggcgacggagtaaacatttagcttctcaagttctttgccggacagaatctgtacaggagacatctttttttgcatccggttgctgtagatagtaacttctttgagtttgagaagtgtatcagacagagaagtctgatgccgaaccctggactgggaaatggctggtactgtggtaaatagagatagaatcaaacataatatccaccgtaaatggatacaatgcttattgtatgaatggacttgaatagaaagcatgtcttttattttataggtataaaaaatccgtttgttcagatctgaattcaatctacacaaacggacatatagctattataccaaataaaagataattgcttattttctatttgactactacccgaaatcccgcaggtgtaaatcagagcatcaaggcaggtcttctgactcatcccattttgcaacgccttcccagataaactatccagtgactttcgtgttgcaattttgctctctgattacaaggagcggagatttacagcagcaggttctgttgccggtttacacggcattcccttttcattccttaacaacgcaaaagttgtttaaggaaaccttaatggcacaaagttagaaagtttttattaattagtttgttttattctaaaaaaatatcccactgaccaataacaaatattccggcatctgattctgttttccccatttgttaataatcaattggatggaaaaaggatatattaatatgttatcccaacgacagaatcaatatttgtgccgtcaatactcgcagaaacatggtgagcggatacaccgtagcgtagccgacggcaggcgcatcacaggaggtcaggtcattggagtaagccaatgccggcggattggtggtagaaccagccagaactccgataagcgtgaaataattcagcttgcaataataccgtcctatcaatcccgtaatcagaagtggcaggatggttatgattactccgtagcctacccatatatatcctccgccatgaatgactgtgtctacaaagccttcgcctgctcctaaacctacgcaagcgaggaagatggaaataccgatttcacgaagcatcaggttggcactcatggtggtataagtaatcagcttgtatttcggaccgaaacggctaatcaggatagaaacgatgagcggaccgcctgccaatcctagtttcacaggttgcggaattccgggaaatgcgaaaggaagacttcccagaatacatcctaaagcgatacctataaagataggaatcaggttcggatgatttaagcgtttcatggagttgccaagtactttctctgcatgggcaacagccagttcggaacctacaatggtgacacggtctcccatttgtaactgtaattgtggagaggctaccaagtctactcccgaacgattgacgcgggtgatgtttgctccgaagttatttctgattttgagttgtgaaagcgttttcccgttcaattccggtttagtaatcaggatacggcgtgaaatgagctctttgttcagttgttcccattccattttgatttcctttccgaagaatacagtaattgcttccacgtcaatcggggtagagatcactaatatgatatcccctacatgtagaattgtttcggaattgaccaattcggtttctccaccctcgcggtgtttgatgcgggaaatgacaaacttacggttcagtaacgggcggagttctttaatcctgatgccatctaccgattcgtttctcacttcaatggagatagggcgtacggtaagttcctggagatgtcccagaccgacttctgcttctttttcttcttgagcagtattgatgcgaaggagatatttcaaagcaagcagggaaaggatgatacctactacacccagcggatagctgacagcatatcctaaagcaatttcgggagcatctatgccattcaaatcactgttggcctgttgtgcggctcccagccccggagtattggtgacggctccggacaaaatacctaccattgtggtaatcggagttccggtggtgaagtgcaggataatagtaatggttactcctaatactactacgagcatagctagcatattcagggtaaagcccccctttttgaatgctgaaaaaaagccgggtcctacctgcaaaccaattgagtaaacaaacagaatcaatccgaattcttttagaaagtggagcaggtgttcgtccagattcatgttgaaatgaccgaatacgattccgacaaagagtatccaggtaactcctagagatactccccgcactttgatttttgcaaggatgattccaaacgctatggttagtgacagaatcagtacggagtgtgccactccgccgccccaaagattggggtaaccttcaaataaatttcttagaacttccattgtgattattatatgatgatatttagtttagctaaaagtaaccccggagaaatcacttctgcggggatacgcacacattgagcatgacggtctaatgccgtccttttgatattttagctagagagaatttatcctccttcaatcatttccgatgtcatgactactcgattattttttacagtttgccattttcctatcccacgagtaaaaacagctataaaggtatgaatggcaggtcttctgactgactcccttcctgattccttcccgaccttgactatctatacccggtcagtggtaaaagtaaatatcaagaagttgaatagagtttcacagcagcgggactgtccgggatttacacccgattcccttttaattcagatagttgatatggctatctgaaaccaattcaggggcaaagatagcgaatttatatagaacccaaatgaatgctacctatttattttatacacagtctgattcttgtcggatatctgtttgtttatttgatgcgtactctcatctcctgcacatcaaacgtgacggattcatttcggaaaagtctttctatatgtccgctggccaccatttccggagtaggcagcgtgtacatctgcggattatctatgagcatgatggagtcgcaaagcgataaggcgatgtcgaggtcatgagtggagaataagacacattttttttcttcctgtgccagtttctttaaaagcaaacagagctcgtagcggttaggtaagtccaggaaggcggtcggttcatcaagcaggatgacgggagtatcctgtgcaagagcacgggcaatcataattcgctgacattcgccatcggacattttatccattgtcttttctgcataaccggacataccgactagctgcatagcgtcatccacccgcttttggtcttccggttgcagttggccgatccagttggtatagggagcacgccctaaagctactacatctttacagcggagattagcgatgcgtactttatcggtggtgacaaagctgatattccgggctaatttttccggtttcaatgaagctatgttttttccttgcagagtaatttctcctgattgaggcttttccagtcccatcatggcacggagtagggtgctctttcccgttccgttacgtcctaacagggcaacgagttgtccgcctgtgattcgggcatttaccgtttccaacagcgtgcgctgtccatatcctaatgtcagttctttaagttctatcatttgaatctacgcaagtttttagcaattacccataaaataaccggaacacctagtaaggcggtgatgcagttaaccggaagtaggaacttcttggcgatgatgtcgcagagaagcatgctgataagccctgtcagcatggtgccggggaccagtatccggtggtcggcattgttgaatagcagtcgtgtgacatgcggtactgccaggccgataaatcctaccggaccacagaaagcggtgaccgttcctgtcagcagtgcggtagaaacgaagatgaacatgcgtgaacgtttaatgttcattcccatcgttcgtgcataattttcaccgagcagtaacaggttcagcgatttgatacaggctacggaaattagtaaaccgatacataacattggtatcataattcccagttgggtgactgtgatgtggctaagagatcccattgaccagagtgtgaacattttcagttgttcggcagaacttaggtattggagtatctgaatgatagcacctgctacgtagcctatcataactcccataatcaatacaccgagaatgttttttactttccggctgataatggctactcccaataagattatggcagttcctatccagcccgaacctacgatacccagcgactgaagaattggaaactccgcccatccaagtaatggagcacctagtatgaacagagctacgcccagtcctgcaccggaacttactcccagcaggtaaggatctgccaacggattctggaatactgtttgcatctgtaaaccgctaacggagagtgctattcctatcaaagccgctaccactacccgtatgaaacggatagaaaggagaatattccgtgtcatttcgtcacattcgcctccggtgagtacagcccataccttggtgataggaatatatgtatctcccgttgccatgtctatcagtaataacagtatggtaactatacccagtgtaatgaataaaaagggagtacgtttatcaggctgtttcattccaggtgtctgtaatagtaaagtgaatcggatacgagttcggggtgaaagatatgaatcagatcacgcaatacgacgtcgggacgtaccactgcagattcccagtagtcattacctcctgtcggtgttgttcgtaaattgttgttgtaaacagttttttcgcgtacagctttggcgtctacaaatttaggattgaccgtctttaattcatccaacgtagaagccatgcctacattaatccagtagtcggccttttgtatcagtttgtaagctgtttccagtccgatgggagtggaactgttagaagtgttttctttgtagatgtaatccgcacctgcatcagttaccaattgtgccatataactttgtgtggaaggcatcacccaactgtcgttccacggggtattgagcataacggtaggacgttgctctaccgattcggtgagcgctttcaaaacttgataacgtttagggatttcacggaatatttcgatgcctttttccctgctgtctgttaattcggcaagagctaccagccattcggctttaccaagcggtgattcctccaaatattctcctacatacatataaggtatatacagttctttcagtttgtctgttacggcagtttgcgcatctccgataccgtataacaggacaacatccggtttcagtcccaataataattcataattcatttcgggacccatgtccttgatagaatctttgtgtgcaagaatatatggattggatacatagtcgatgcccgatactccgacaattttgtccacttgacctagagcgtcgaacatggcgatgtaggaagaagccatacatacgatacgtttcgctccggcagggatggtaggcccgttgaatccggcaggtgcctgttcaccgttgcgtgaaatgaaataagacatttttacgtccttggctccctgccatggattggatacctgaataagtgtgctggcggcattgtccgcacccagaatcttgaatccggtagcatattcaggtgtatagacatcctgtttgaaagcctcgagagaagtcttcttgttggatatacaactagccaggaaaagaagacatagccatgtgaggattgaaataggagatttcatctttattcgtgtatcttttaaatgaataaataattttcggtgtccgaagattgacattgcggggcaaagataagtatctttggagatattctttctttttttattgcattttctccgaaatcattcctatttatgtatcctccccttaggcaggcagaatggattaagtttatcggtctgctgattacttcagagaatttctgcaccttaaagattcagaaaaaatttggagatgctttttatcctcgcactctcaccctgtctcgtcttgatttggttgataggttaaacctgaagtttataaggatatagtaaatccatcgaaagtatgtagttatttgcagaatctatgcagataatggcttgttcatataggtaaacacttagtttcaagtagcgaaacattttgtttctcggtgtgaaacacttcgtttcattacttgaaacatttcgtttctcggtgcgaaacactttgtcccaagtaatgaaataaagtggaactgccgtcaaccgaaaattctccagtaagtaattattaaacagggtgtgagggtaaagacatcgcaaacttattagagatatctacacctgtttgtttacgggcactcttgatatagaaaaactcctccgtaggcaggtactgcctgaaatgcttcttccgggtgaatcaactttgcataaatctgtgcgcaaatcaatacgccgccatgagcgaatactactgtattttcaccctccttttgtctgacttcgtctaaaaacgcggctacccgtttatattgatcggcaaacgattctccattggttgcttttacattcaagtagtcgtcgtaccagcattggagattcgggtctttgattttatgaaaatactgcatttcccaatctccgaagttaagttccagtattcttgggtcacggatggcatctccgaatccgcaatactgtgccagacgggtgcatctggatagaggactggtgtaagccatatcaaagtgaatggattcgattttagctttggttacagctgcttctgcctcaaatgtaggacgtaaaggaacgtctgactgaccgtaacaaagacctttaggaacgtcgacagaggtatgtctgattagataaatattcataggtttacttattttatatagatagacatcactgctcccagccagaaactcatttcgcttaggagaaataatgcaccgcaacaatctccggtatatccgttcagacgtcgtttcatcatccggcagataaagaagaataccagaatgggaaatatacatacgggccagtagcttggaggaagtaataggagaggcagtattccacccatcgcagacattacgatctccccaaaattcattcttgtatatactgttccggatttgctatcttcttctttacgtgcatagggcaggtaattgatgatattggaagaaatgaatttactccaggtatctccgcttagtaataagaaaggagtaactgctaagggaagtgcgaccagtagattgtaagcaaataaataatagatgattaatcccaaaactccatagcttccgatatgggaatctttcatgatgcgtaacgtgctttccctgttcgttccacctccgaatccatcgaagaaatcggccaatccatcctcatgcaatgctcctgtgataagtaaacgtgaagtcagtgccaggatcacggctactccgtgaggtaaaatagtactggctccccagaaaatcaatgccatcattcccccggtcagccagccactgaaactccaataattgacaacgtgtttgaaacactcctgcggaacttcttttattttccagaaaggcaatcgtgtaaagaatatgagggcggcaagtatctggttcattttagaaatatttagtgatggaagcatgagcaaatgaatccatctcattcagcattttcacagcagaatctacaatgggataggcacaaacggaaccgcttccttctccaagtcttagtccgagattgagtaggggacgtgctccgagatagtccaataatagcttatgtccgctctcgtctccctgatgaccgaatatggcatagctcatcacttccggataaaggcgtgaagcggcaagaatacaattggtcataataaatccatcaattagaataaccattcccagttcggcagctttgagcattgctcctacggccattaccatttcgtaacctccgaaacggcagaggatttcttctgcggaatgctctcccggatattgttcgagagatcttttcagaacttcgtatttgtggtttattccctggtgattgagtccgcttcctgcacctacacattgatctaatgggattccggtgaagcaagtcatccatagagaagaggacgaagtatttccgattcccatttcaccgaaactaatgacattgcagccttcctggtgagaagcatccacacattgagcaccacgctccaggcaaagttccatctcttcgggcatcatggctgcttcgtacaggaaattgcgtgttcctcttccgactttcatgttaatgatacctttttcataaggtaaatcataatcgactcctgcgtctacaattttaagagtgaaaccgtgctgtcggcacaggaaattgatccctgctcccccatgaagaaagttgctgatttgttgccaggttacttctttaggagatgggctgactttttcttctacgatgccatgatccgcggcaaagattatattttgaggatgagttaatcgtggagaaagggattgttggatcagtccgatttgcaaagcaatttcttccagtcttccaagcgatcctttaggcttggtcagattattgattttgtcaatcagagcttctttgatagcttcatctggcttttgaatatgaaatgttttcatgtttattttatttttacgggaataccacttgccatgagatatacatcgtcggcatgcgatgcgatgtattgattggtccaaccttgcaagtctgtgaatttacgttgcagtttgttctcggaaactccccccccaaccaatctcattagttacaaatatgaaagtggcatcctgctgggtaaatttgtcgaattcttttttgacggcttccaatgaggaggcaacgttagaatcaaactccataaagaagttagtgcaccaaagagttacacaatctatcactacgactctgcccgctacattgtgacggctcaattctttttcttcttctatatttatccattcaggaccgcggttcttttgatggcgttccaccctttttctgaattcttcgtcccatatcctggcagtggccaagtaaaccggtgacgtagtaagttcatgcgctttattttccgcgaacgaacttttaccggatcgttgtcctcctgtgattagtataatccttttcattaagttgctgattgaataatggatggacaaaggtataaaaaataactccgggattaaccgttttacgtaaaagttattaactttgtcccgatttgttttagatcaacataaatatcagacttaactactattggatatgaacgcttgtaagttagtgggattgcttttgctgctactttggggacatactgctctgtatgctcaacaagtgagaactgtgcgaggaagagtgcagacagtggaagccggcagtaatgagaagcgggcattaccatctgccagcattgttattttggcgaaaagtgattctgcctttatcaagggaataacaagtgataagaatgggcgtttcattcttaattatcaaccgcagaagaaaaagaaatacctgttgaaggtctcttttatgggaatgcaatctgtataccgggcactggaagactctgtatcggtgaatatcggtacagtggtattgaaagatgatgatattcagattagtgaagtgacgataacgggaaaattgcaggaagtagtgatggagggagatactacggttatcaatgctgccgcttttaaaactcctgaaggagcttatctggaagatttagtgaagcgtgttcccggattggtatataataagaaagataattcgttgacatacaacggacagcccatcagtgaaatcaatgtaaatggcgaagcttttttctccggagataaaaagacggcactcgaaaatcttccggcagacctgattagtaagttgaaagtatatgataagaaatcgaaagaagaggagttcaccggaattagttcaggagaaaagaaatatgtactcgacttgcagactaaggatgaattgaataaaacctggctgacaaatgcaacggtaggatacgggaataaccagaagaaggatttcgaggggcaagtgaattattttagtaaagacggagataatctttcttttatcgcacagtctaccaacagataccagaatagtacgtacaaggataatatcaacaattcggtaggaatgaatatgactcataaattcggtaagaaattctccctgaccggaagtgtgaactataatttgaaccggaacggaaatctttcttccatttatcaggaacagtatttgccggcaggtaatcaatactctgcgtctactaacgaaagtaactctaaggggcggtcgattagttctaacttcatgggaagctgggaagtagataaacgtacacgtatacattttaccggtaatttaggaatctctcctaataggaatgaaaacagtagccagaatgcatcttttgatgctcctcccggcataaatcatgagagcttgtttgatgactttgaatctattccccgggatataaaagtgaatcgtagcgagaaccggtcgcgttcggagaatcagtcgaaccgttatagctggatgatgagtattatgagacgtctgaatgaaaaaggtacaacgctggcattgaatatcctgaactcggattcgtggggagataatgaaagtttttcgctttctaaaactacttatttccgtcttgaagataaattgggaaatgattcggtgctttttcgtaaccagtatttgaagtcgcctcaaaaaaataattcatggagagtcgggattacctttgcccagcctattggtaagaagatgcatttccgggtagcatataactgggatactaactatgagcgtgataatcgtgatacgtatgaattatcttctctgacgaagtcggaagtctttggtgaactacctcccgactatgaagcagggtatgtggatagtttgagtaatcggagtcatagtcgtacgaatggccataatctggatgtggggcttaattactctgatgatacctggatgtttaatgcctcattagggatgactccgcaaaaacgtgccattgaacggaaaatgggaaagctctatgcggacactaccatgcatactatcgactttcagcctatgatatgggtgaattggaaaaagaaagaggcccggatcactttcaattatagcggtagaacccggcaaccctccttatcagatttaataccgctgacggataacagtaatccgttgtatatcacccggggaaatccggatttgaaacagatgttttctcatagtgtccgtgtgagctttcaacattcaaaaaaaggtatatctgcgaatatcggtgggcagatggaacagaacagtgtgacgcaggtagtgctatatgatgcaaaaaccggcggacgtgagacatctcctattaatattaacggaaactggaatgtatatggaagtgccaactggtggaagcgtctgggacatttttccttgcggttggatatgaacggtaatcatagcaatcgtgtcagtatgattaatgaagacaagagcctcgaaccgaagaaaagtacgacacgtgataccggattggggtgtgacgcgaatgtatcttatcagcccacctggggaggtattgatttctctacttcctggaattatcagtattcgcttaattctatcaatgataacgatacctatacgcgtaattatagttttcgtcttgaagggtacgttgatcttccttttggcttgcaattacggactgacggggcttattctttccgtaatggtacgaatatccgtaaaggcgaagatgaccagatgttgtggaatgcaagtgccagctggcggttcttgaaaaagaaagaagcggaactgtctgcttattgggcggatattctcgggaagaggaaaagtttcggccgtacgacttcttctgatggtttttatgagttccgtaaccaggaaataaaaggatatttcatagtcactttcaaatataactttcgtttgatgatgtgatttttagaaaaaagtcgtatgtttgctacagaaccataaaacaaaatgtactatgagcggtaattatgttatcaatatcggccgtcagttaggtagcggcggaaaagaaataggagagaagttggcagtccgtttgggaatcaacttctacgacaaggaactgattaatctggcttcggaggaaagtggattgtgtaaggagttttttgaaaaggctgatgaaaaagcctcgcagggtattattggcggactgttcggtatgcgtttcccttttatcagtgagggagctatgccatgtaacaactgcttgagcaatgatgccttgttcaaagtacagagtgatgtgatccgtcatctggcagcagaaagatcttgtgtctttgtaggacgttgcgcagattatattctgagagagcatcctcgttgcgctaatgtttttatttcagcctctaaagaagatcgcatagcgcggttgtgtggcatgcatcatattgatgcggaagctgcagaagaaatgatcgaaaaagcggataagagacgttcggaatactataattattatagctataaaacgtggggagcagcagctacttatcatttgtgcatcgattcttcttctttgggaattgaagagacagtgcggttcattgaagaatttgtagtaaagaaactgcagcttgtatgacaggatagaaaagcagattgaaaaaataaataaagccggcatattccatttggatatagccggctttattgtttatatgctaaacttgatttacatcattgctaataatatcatctgtcccgttagaatacggaggaacattgataacggataaactgtagagtatcccactgccggagcatctccggaggttgtttgattggcataagccaatgccggtgggtcggtattactaccggctatcaatcccatcagggtgaagtagtttaccttataatataatcttgcgatggtgccgatgataagtagcgggataacggtgataaggaaaccggaacctacgtatagtaatccgtctccctcgactaccgtttgcacgaaattggcaccggcatctataccgacactggcaaggaagagaacgataccgatttcacgaagcatcaggttggcactcatggttgtataagtcactaaatgcagcttatgaccgaaacggccgataagaatagccactaccagcggtccgcctgccaaacctaattttaaaggagtcggcatacccgggaatgcaatcggaagactacccagaaggatacctaagaagataccaacgaagatcgtaacaatgttcggtgtatccaagcgtttcaactgattacccagtacaccggcaacacgttccactgcatcttgctgtcctaccaccataacgcggtcacctacctgaagtatcagattcggatcggcaaacaggtccataccggaacggttgatacgagtgacattgaccccatacatactacggaagtgcatagaacctaatgttttaccattgatttccggtttggtaaccagaatacgacgggaaaccattgggaggtcttgtttttcccagtcgagctccacttcttttccgataaatactacaattgcaggagcgtcttcttccgagcagacgataaataactggtcgcctatattaaacactgtttcatggtcgggaatacttacatgaccatcatggcgaattcgggagcaaacgaacttacggcccaggaaattcttgatttcaatcagcgtttttccactaattgattcattgcgaacttccaggctcatcatgtgaggtttgtggtgtgaatctccactttggattttcaggctttcttcttctttcgccatattgacacggaagatgtaacggatggcaatgatagaaccaatgatacctaccacaccgaggggataagcacatgcataaccgagagcaatctgcggaccggtataatgcaactgattcagagcctcattggcagcaccaagtcccggagtatttgtcactgctccgtaaaggatacctaccatcatcggcagttctacccggccgttccagaggtaataaagccccagtgcgacagcaatatttaacactacgatgcctacagccaacaggtttaatgtcattcctccttttttgaaagaggagaagaaagatggccccacctgaagaccgatacagaatacgaacaagatcaatccgaattcacggatgaaatgtaggatgtgtgtatcggctgtgaagccgaaatgtcccattaggatgccggcaaacaaaacaaatgtgacgcccaaagaaactccgaatatctttatcttaccaagatacacgccggcagccactacaaatgcgtagaggagcacgatgtgagctacggagctggggtcccataataaactttgtaaccaatccataatatagcagtttttataatgtttttctaaaaacgagtgcaaaattactcataacattggagctaatcaaataaaagaagaactaaaaatgaagaatttctatgcagattgtatgcacttgacgaatcggggcgtcctgtgcgaattttccctaaaaaagagattcgttttaacttattggttatatttgcaggtcgaacgactgacatttagaaagagatagataaaaataaagacaatattaatcttgttttaattttaaataaactatggcagacaaaaaagaaaaactcttctcagacttttctcctgcctccaccgaacaatggatggagaaggttacagccgatttaaaaggtgctgattttgagaagaagctcgtttggaaaacaaacgaagggtttaaagtgaaacctttttaccggatggaagatctggaggatttaaaaactactgatgcacttcctggagagttcccttatttaagaggaactaaaaaagacaacaatgcatggttggttcgtcaggaaattagagtagaatgtccgaaagaagccaatgcgaaagcactggatatcctaaataagggtgttgactcactttctttccatgtgaaagcaaaagaacttaatgcggaatatattgaaacactgttaagtgatattcaggcagggtgtgttgaactgaatttctcaacctgtcaggggcatgtggttgagttggctaatctgctggtagcttatttccagaagaaagattatgatgtgaagaaactgaaaggttctatcaactatgatttcttcaacaagatgctgactcgtggcaaggagaaaggtgatatggtacaaacagccaaatctttgattgaagccattcagccgcttcctttctatcgtgtgctgaatgtaaacgctttatcattgaataatgcaggcgcttatatttctcaggaactgggttatgctctggcttggggaaatgaatatatgggtcaattgactgatgccggtattcctgctgccatagtagccaagaaaatcaaatttaattttggtatcagttccaattatttccttgaaatagcgaaattccgtgcggcacgtttgctttgggcaaatattgtagcttcttacaatcccgaatgtgtgcgtgattgcgagaataaaggtcctaacggagaatgtcgttgcgcagcaaaaatggcggttcatgccgaaacttctactttcaatcttactttgtttgatgcacatgtaaatctgcttcgtacacagactgaagccatgagtgctgcattaggaggcgtagactctatgacggtaactccgtttgataagacttatgagactccggacgagttctcagaacgcctggctcgtaaccaacaactgctgctgaaagaagaatctcattttgataaagtgatcgaccctgctgccggttcttattatatcgagaatctgactgtggctattgcaaaacaggcttgggaactcttccttgctgtagaagaagcaggtggcttctatgcggcattgaaagcaggaactgttcaggctgctgtgaatgagagcaacaaagctcgtcataaagcagttgcacagcgtcgtgaagtgctgttgggtaccaaccaattcccgaacttcaatgaaaaggctggcaataagcaacctgttgaaggtaagtgttgttgcggaggtgactctcacacttgcgaaaaagaggtggatactctggtgttcgatcgtgctgccagtcagtttgaagcattgcgtctcgaaacagaagcatcaggcaaacgtccgaaagcgttcatgttaaccattggtaatctggccatgcgtcaggcacgtgctcaatattcttgtaacttcctggcttgtgccggttatgaagtaattgataatctgggatttgagacagtagaagcaggagtagaggcagctatagctgcaaaagctgatattgttgttatctgttccagcgatgatgaatatgctgaatatgcaattcctgctttcaaagcactgaatggtcgtgctatgtttatcgttgccggtgctccggcttgtatggacgacctgaaagctgcaggtatcgaaaacttcatccatgttcgtgtcaatgtattggataccttgaaagagtttaacgctaaactattgaagtaagatgagaaaagattttaaaaacatcgatatatatgccgcatttcagccgactaatggtgctgaatggcaaaaggctaacggtatctccgctgactggaaaacaccggaacacattgaagtgaagcctgtttatacaaaagaagacctcgaaggaatggaacaccttggctatgctgccggacttcctccttatctgcgcggtccgtattcagttatgtacactcttcgtccttggaccatccgccagtatgccggattctctaccgccgaagaatcaaatgcattttatcgccgtaatttggctgccggtcagaaaggtttgtcagtggcattcgacttggctactcaccgcggttatgaccccgatcacgaacgtgtagtaggtgacgtaggtaaagccggtgtatctatctgttcattggaaaatatgaaagtgctgtttgatggtatcccattgaacaagatgtctgtgtctatgacaatgaatggagctgtacttccgattatggcattctatatcaatgccggtctggaacaaggtgctaaactcgaagaaatggccggtactatccagaatgatattctgaaagaattcatggtgcgtaatacttatatttatccgcctgcattctctatgaagattatttctgatattttcgaatacacttcgcagaagatgcctaagttcaactctatctctatctccggttatcacatgcaggaagcaggcgcaaccgcggatatcgagttagcttatacattggccgatggtttggaatatcttcgtgcaggaacggcagcaggcattgatattgatgcatttgcaccgcgtctgtctttcttctgggcgattggaaccaatcactttatggaaatagccaagatgcgtgctgcacgtatgttgtgggcaaagattgtgaaacaattcaatccgaagaacccgaaatcactggcgttgcgtactcactcgcagacttccggctggtcactgaccgaacaggatccgttcaataacgtaggacgtacctgtattgaggctatggctgcagctttggggcatactcaatctttgcataccaatgcattggatgaggctattgctcttccaacagatttttctgcacgtattgcacgtaatacacagatttacattcaggaagaaacttacatctgcaagaacgttgacccatggggtggttcttactatgtagaatctctgacgaacgaactggcacacaaggcttgggagcatattcaggaaattgaaaaactgggtggtatggcgaaagctatcgaaacaggtattccaaagatgcgtatcgaagaagctgctgcacgtacacaggctcgtatcgacagtggtcagcagacaattgtcggtgtgaacaagtatcgtctggaaaaagaagctccgattgatattctagaaattgataatacagccgttcgtcttgaacagattgaaaacctgaaacgtttgaaagatggacgtaatcaggctgaagtggacaaagcattggcagcaattaccgaatgtgtgaagactggcaagggtaacttgttggaattggctgtggaagcagctcgtgttcgcgcaacattgggtgaaatttcttatgcttgcgaacagatagtaggacgttataaagcaataattagaacgatatcaggcgtgtattcatcagaaagtaaaaacgatagcgacttcaaacgtgcttgtgaactggccgagaagttcgcgaagaaagaggggcgtcaacctcgtatcatggttgcaaagatgggacaggacggtcacgaccgtggtgctaaagtcgtagcaaccggttatgctgactgtggcttcgatgtggatatgggaccgttgttccagactccggcggaagctgctcgcgaggctgttgaaaacgacgttcatgtagtaggtgtttcttcactggctgccggacataagacattggttccgcaaattattgaagaactgaagaaactgggtcgcgaagacattgtagtgattgccggtggtgttattcctgcacaagattacgatttcttgtataaggcaggtgtagctgctatcttcggtccgggtactccggtagcgaaagctgcttgtcagattctggaaatcctaatggatgaagaataacttctgaaattatttgaatcatatttatactcccaccttttagacctgtttggggttagaaggtgggatgtttttttatttatattctttgtcttctcctaattttgtctatatttgtccagctttcattgtaaaaagacttaatgaatgaatggaaagagagatgacatggatgcccgttttgagcaattttatgccgctaatttcccccgagtcaagaattttgcgcggttgttgaccaagtcggaggaggatgcagaagatattgcccaaaatatatttcttaagttatggacccgtcctgaattgtgggaggggcaggaaaccatgactagttatctttataccgtgacccggaatgaaatattcaatctgttcaagcatcagaaggtagaacaggaatatgaagataaagttttgaaagcacagttgttgggtgaactttgtgatgaagattcctccctgttagaaaatctatattataaagaagtgctgctgcttatcaaaatgacgcttagtcagttgcctgaccgccgtagacaggtttttgagatgagtcgttttgaggggctttctcataaagaaatagcagataaattacaaatccccttacgtacagtagaagatcatatctataaaacattgactgaacttcgtaaaatgttaatgtttgttattctattccgaatcttcccgtagtttttctttctggatagtgatatttatgtaagcgttttaaaatacaataataaatatcactttatgaagaattatattcgagacgtaatcgaccgctatattaaacatgactatccggaggaagtcaatcaggattttcgtacatggttgactgacgaagagcgtgccgacgaaaaagaacatgaactaaataaactttgggaggcgaccgaagctgtcacaactcccggttatcgtgattctctggaacggatgcatgaacttacgggaatcggatcaagacgacggatttattctttacgtacccgtttagtggtttggcgggtagcggcagctttattgataactgtttcttctatttctatctatctggcattgcagaaccgccaggctccggacctgttgcaagcatatattcctacagccgagacacgaaatataactttgccggacggtacacaagtgttgataaattctcaaagtactttactttatccacagcaattcacgggtgatacacgatgtgtttatctggtaggagaagccaattttaaagtgaagcgtgacgaagagcatccttttattgtgaagtcctccgattttcaggtgaccgcattgggaacagagttcaatgtgaccgcttatccggatgaagacgaagtgacggcaacgttgatttcgggaaaagtgctggtagagtataacggacagaagaatcaggaagttttaaatccgaacgaacagctggcatataataagcgcactcgttccggaaacgtagttcgtcctgatatgcaggatatcacagcctggcaacgtggtgaaatcgtatttcgcagcatgacgctagaggaaatattcacccgtcttgaacgtaaatacccctacacatttgtttacagtttccgtagtctgaaaggtgaccgtttcaatcttactttcgggcaaaatgcttctatagaagaaataatggatatcgttgctcgtgtaacggggaatctgaattatcagattgtgggagacaaatgctatgtttccgctatcgctgaaggtacgttacattatcggagaacgaaataaaaaataagatatactgatattaaccttaaaacacattgagcctatgcggaaaaaatatccgggggaagctgcaaccttcccccggatgtgaaatcggaattcttactattagcgttaaccagacgctactaaattcgagaatctaactttatctgtataaactaatactaagaagatgcagcaaatttatgaatttatagccaataagcagacattcagccgagtatttatgctttttttgtgctgtctgctcctttctacatccacttttgctcaaaatagcagtgcccggattacgatccataagaaaaatatatcggttatcgaggcattgaaagaagtggaaaaacaaacgaaactgtccgttggctacaacgaatcgcagttgaaaaacaaaccctccatcaatttggcgttggaaaaggctacgttggagagttctttcaaagaaatccttaaaaatacaggatatacctatcagttaaaaggaaaatacgtaatcatcgttccgcaagaaaaacaggaagtggaaatcgcgtctgccaaacgtatcaccggacgtgtgctggatgataacggagaacctctaattggggttaatgtacatgttgaaggaacgagtgtcgggtctatcacggacatggacggtaattttatactcgaagctcctgtaggaagcgtgttgagtatcagttatgtaggttatactccacagacggtaaaagtgaccggccagaatacgtatagtgtgcggctggtttcagatacaaaactgttgagtgaagtcgttgtaaccgcacttggtattaaacgcgaacagaaagcgttgagctataacgtacaacaagtaaagtccgacgaactgactcagattaaggatgctaattttgtgaacagcctgaatggtaaagtagcgggagttactatcaatacgagttcttccggtgtcggtggggcaagtagagtggtcatgcgtggtacgaagtccattgaacagagtagcaatgctttgtacgtgattgacggtattcctatgtataatttcggtggcggaggtgacacggaatttggctcaaaaggggccaccgaggcaattgctgatattaatccggaagacatagaaagtatttccgtattgaccggagcagcggcggccgccctttatggtagtaatgcggcgaatggcgcgattgtgattactacgaaaaaaggacaggtaggcaaactgcaagtcggtgtatcaagtggcattgaatggttgaatgcttttaagatgcccgatttccaaggacgttatggtacaggaagtaatggtaaaacaggaaattccaatatttatagctggggaccgaagctgaccccggctgctcaaacaggatatgaaccggatgatttttttgatacgggtgcggtatatacaaattccattacgctgtctaccggaacagataaaaatcagactttcttttctgcagctgccgtcaattcggcagggatggttcccaacaataggtataacagatataattttactttccgtaatacgaccagtttcttgaatgataagatgaaactggatgtaagtgcaagctatattctccagaacgaccgtaatatgaccaatcaggggcagtactccaatccattggtttctgcttatcttttccctcgtggagacgatttctctatcgtgaagaatttcgagcgttgggatgaagcgcgaaagatcagtgtacagttctggccacagggcgaaggtgacctccgtatgcagaatccttactggattgcttaccgtaatctccgtctgaacaacaagaaacgttatatggcttcggcaggtttgagttaccagattcttgactggctgaacgtggcagggcgtgtccgcatcgacaatactcatagcgaatatgaaggtaaactctatgcaagcagtagtaatacgctgactgacggtagtacgcagggacattatacggtaaacaacggacaatattcacagacgtatgccgatgtgttggtgaacatcaacaaacgtattcaggattttacgatagttgccaatattggtgccagttatagtggagtgactagtaaagaattgggctacgccggaccgatacgcgaaacgggtattcctaatttgttcaatgtctacgatcttgacaacgcaaagaaacgtgctacgcaggtagggtggcgtgaagcgaccgagtcagtttttgccagtgccgaagtagggtggaaaagtatgctctacctcaccgtgacaggacgtaacgactgggcttcccagttgacgcattctccgcaggcttctttcttctatccttccgtaggactttcggcagtcatcactgaaatgttgaaactgcccgattgggtggattatcttaaagtacgcggatcgtttagttctgtcggtaatccttatccgcgttttcttacttatcctacttactcgtatgatgccaataagcaagactggaaatcgcagacgaattatcccattggtaaattatatcccgaacgtaccgactcgtgggagatagggttggatgcaaccttatttaaagatttcaagttgagcggatcattctattacgctaatacttacaatcagacattcgacccgcggcttcccgtatcgtcgggatacgataaactgtatgtgcagacaggatatgtacgtaactacggtttcgaggctatgttgtcttatggacatcgttggggagatttcagttgggacagcagttttacattctcggccaacaagaatgaaatcgtagaattggtaaaagattacgttcatccggaaacgggcaagacatacaatgtggataaactggaactcaaaaccgatgaaggacgcggattcggaaaggcgaaatttatcctgaaagagggtggtactttgggtgatctttatacacatgccgatttgaaacgtgatattaacggtaatatactgatcgacgatagcggcaatgtgacagccatcgacaatgcaggtgatatcaagttgggaagcgtacttcctaaggcaaatctggcttggaataatagcttttcttataaaggtatcaatgccggtttcctgttgacagcccgtctgggaggaatcgtttattcggcaacacaggcctatcttgatctctatggagtatctgaaacctctgctgccgcgcgtgatgccggaggggtgtgggtgaatgggcgcagccgggtgaatccacagagtttctatgaggtagtagcttcgcagagcggattgcctacttactatacttatagtgctaccaacttgcgactgcaggaggcacatatcggttatactattccgcgtcgctggctaggcaatgtttgtgatatcaatgtatcccttgtgggaagaaatctctggatgatctactgtaaagcccctttcgatcctgaagcagtagctactacgaacaactattatcagggaatcgactacttcatgatgccgagtacccggaatataggtttcaatataaagattaacttctaaatactatgatggacatgaaacgaatatataacattcttctgataatgatcctttcattatttctgctcccgttgggcggttgtttcgacagtgatatcaaccggagtatgtatgaagcggacggagaagaaatgcagcgtgagaatcatattgtcggtgctacgctcaaaggaatgcaggggttggttatccctacacgtgagcacctttaccagtttatggatgccatggcaggaggagcttatggtggctatctggaaggaatcgtagacacttgggtgatgaaattctccactttcaatcccgaacagggatggctgaaatctccatttgccgatccgatcaaagatatgtatccgcagtatcgtgatatgctgaacaagacggatgattctgtggctttagctttcggtaaaatcctccgtgtctgtatcatgcatcgtgtgacggatatttatggtccgattccttactcgaagatgatggataatgataattcgggtgaagatttggctgtcccttatgattcgcaggaacaagtatatacacagatgctgaaggaactggaagaagcggataaagtactggaagaaaataaagacttgtcgtccgaggctttccgcaaattggaagatctgtattacggaaatatttccaaatggcgtaagtttgtacattccatgcaacttcgtattgccatgcgtatgagctatgtcaatcctactgaagcacaacgtattgcgcaggaggctgtggaagccggagtgattgaatcgaatgaggataacgccatgcttcatgtggcggagaaccgttcggaattgttatttaataattggaatgactaccgtatcagtgccgatttggtttctattatgaaaggttatgaagatccgcgtttggataagatgtttgtcaaaggggtgcagacagtcgatcaggatggcgagaaagtcgatgtatacgactattatggtgtacgtatcggcatattcacccagaagaaagacgacatgattaatctttactcgaagcaggtgatttccagcaccgacccgtatctctggatgaatgcggcggaggtgactttccttcgtgccgaaggcgcgttgcgtggttgggatatgggaggtgatgcgcaggcattgtatgaaaaggcgattgccctttcattcgaagagcgcggcggaaccaccggagcggaccgatatgtgaaggatacagagaaaaagcctatagactatgtgaacccgatggacggggctgatataaagtatagtcattcggctgtaagcaccattacgattgcttgggaacctggagcggagaattttgaacggaacctggagcgtatcattactcaaaaatggattgcaatattcccgctgggactggaagcatgggcggaacatcgtcgtacgggctacccgaagttgttgcctgccgtggagaataaagaccccaacaatagtgtgaatgtaacgatcggtccccgtcgtctgcctttccctgccgatgaatatacggggaatccgaaatacatagatcaagctgtacaaatgctgaatggtcccgatgccgcaggaactaaactttggtgggataagaaagaccattccattgagaatagtcaatcttcaaactagaacgaacctttaaatcaatgagattatgaaatataaatcaatctttaagttatgcctactgactactttcctgtcggttgccaccatcagttgcgacgactggacggaaatggaaatacacgatagtcaggtgaatgggtttaaggaacagaatccgcaagaatatgcggcatatacgcagaatctacgtgcgtataaggcaacgaaacacgctgtcgtttatgcccggttggataatgctccagaagtatctatcggtgagaaggattttcttcgtgcgttgccggatagtatcgatatagtaacgatgcgtaatgcagaccgtctttccgaatatgaccgggaggatatgaagttggtacgtgaggattatggaacgaaggtgctttactatatagattgcacggctaaagataaacagaatacctctattacctctgctgttgaggcagtgcgtacagggacatttgacgggattgccctcggttcggaaggctctgcggtagatgtttcggtgttaaagccactggtagatgctttgggacagacaccgtgtctgttagtttttgaaggtaccccttcattgttgccggaagcgcagcgcagccttttcaactatttcgtacttgatatttccgctgcatccgatgaatatgatatagaaacctccgtgctctatgccaccggatatggcaaggccgcaccggatcgtctgctgttggccgtcactcctgacggtacattaaccgacaataacggagtgacgcgcaatgccatcgccggagctgcttacggtgctctcaatatggaaacgccattgggaggtattgctatttacaatatctctgccgattactacgatactgatattatttataaacagacccgtggaggtattcaattcctgaatcctgcttcggttcattaaacgatgtaagctatgagaatacataaactttatcagtgctttgcagctgcagttttgttatttctgctggttgcctgtgataatacggattacagcgaaaagtcaccgttcgataattcggcatacctgaatgtggctgctagtaagaatacggaaacttttacttttaatcgtaaagtaacgagccagacgaaaacgtttacagtgaaattgtcatatcctgcaggggatgattccaaggtaagtttaaaggtagatccttcattagtcggtgtatataatgcgaagaatgacactcattatgagatgttgcctgccgaacattatcaattatcgcaggagtccgttacaattcctgccggaaaaacgacttcggaagacatcagtattcgattcttgaaactcgacgaactggagattgacgccacttacctctgtccgctttctattggcggggctgaaggagtgggagtaatggacggctcacgcacaatgtattatctggtgcgtcgctctagtgctataacaacggcaatgaatctcaagaatgtctatgttaccgttccaggatttgataagggaagtgcgacggcggatgttgtgaataatctaagcgctgtgacgatggaggcgattatacgggtgaatacgtttgacgaaggcaccgaaatctcttccattatgggcattgaaatgtatcttcaaatgcgtttgggagacgccaacttccctcgccagcagttgcaggtacagacaacttttggtaaatttcccgaagcgagcaagaccaaacaactgcaagccggtgaatggtatcatgtggcgttgacatgggatttggctactaagactatcgcttattatgtaaacgggcagttgcagagcattagtaccaatcatggtaaaagtgacctgactagcatcagtttgggtgataaagtgcctgatgatgaatttggaaatggtggagatcacaatttctacttcggtcgttcttatacagagtcacacgacttgagtcgtcaatttaacggtgaaatctgtgaagcccgtatctggagcatagctcgtacacaagagcagatttgtcagaatatgtatgatattcctaacccgaccgaagaacctactttgtgtgcctattggaagttcgatgagggaacagggctggaagtggaagaccggactggacatgggaacaatgcgaaagtggttccttattggaaagcaagcgaccacgtggaagcttatagtaaaacagatgccgaattatggcctagcggaatagaggttccgaagattaacaatgaacaataagctaaaaaggagataagtgatgaaaaagataatacaatatatgtgtgctgtagcggggttgctgttaatgctcttgtcttgtcaggacgatgctatgataatcaatcccgatgttacacatggacagtcaactgaaggtgtagaaactgccaatggtaagggtactttgaatagtacgctttgcccggagagtaagattgtattgctcagtatcggagatccaactttggaaggacgtgatgaaactgatttaggaaggaaagatgaactttgccttatccttccaaagccacttgaaaaggatattactttgaagattgctatggaggatgcttatgcaaataatgaaacgatgaaaaatggtggcagttatacaagctttgtagtagagacattccgtagagagtataaaataaagactcaaggttctgattttaatattccagggaataacggattaggaaataccttatcgctaaacggaggaaaagaagccattgtaactatacgggcgggagaacggaagtcagagaaggtcaaattgctttttgaaagagaatatctaagtagcaactatacttatcttttcccgattcaggctgttgaggtggaaacaggggaacttattgatcagatatattacatcattagtcctgttgaagatcaaaaggagataggagaaaagccgggcactgtaatagcttacatagacacggaagtcatgaatcctttgattgcagctcagttttcgcttagtgtcgatttttttgatatgagtgaaggatttgaggaaacgaacatttataaaggtcctttattggatattttgaatgtacgtacggcttttttgaaagaagtacaaggacacgcgacactgacctatacgactgatatggagtatgtactgaaaaatcatagtcactatctgcggcctatgcaagagaatgggttgaaagtctgtcttgccattatgggtggcggaaccggattgggattcgcaaacttgacagatgcacaaattagtgactttgcggcacaagtacaaacagctgtcagcctttatgatttagatggtattaatctttgggacaaaggagcaggttatggcaaagagggaatggcacccataaatgacacttcatatgccaaattgataaaagcattgaaaaatgcgatgccgggtaaattgcttacgttagttgatacccgtgaaactaccgaagcactttgtgatgagcaagcgggcatcagtgtaggtaactatctggattacgcttggagttcgttggaagactttttagcaccttacgaacctgatgctaccatacgtcctttagctggaattccggaaaagaaatatgggactatatttctcagggatatagccgccatgtctcaagaggaacaggtggacttgatggaaaattccataataggcgaatatatgaacatgatgcggtttactccacttagtggaacagatgtggtggtgggagcagatatcccttatatggattatggaaaagagagcgtatggaatgatccttgggcgacatggattttatgtaaatatcctgcgccagaagatttttcaagctccacaatggcgcaaacagaagtaccatactcggtaagagattattatatgtttcagaaagattggtaaataagtacatggattgaacataaagaaaaggctacattattttaattgcatcttgtgtatggaaaataatgtagctttgcaagcagtaacgaattgtaatgccttttgaaatgatggataatttatttagatattcttcataaaatctggttagctgacaacaaagacgataagagcggtcgcctcgaatcgctatcgctactttctacgccggcacgaaacctgatgtagaaggcggttccgactccggcgacagagggggaagaggctcccgcccctgtgacataaatgtttcttagacgatggagcattgctctgtcagcttatgcagaaaggctgtatagctctatacatgcatcatgtatagagttgtgcagccttcgtgtatagagggttgtgcatgataagtgcataactctgatattttttcttgttttgctctctttttcatcaaagactcatgtatatagccatatttgagtttagtattcagctatctttttcgcaatatcttttttatagtactaatttattggtacttttgcctctaccgaaagaaaaaatcgtcgattatggcaagaataacaattccacacgcagtgaccgatttcgcagaccttcgcgaacgtggcttctattatgttgataagacaaattatattccgggacttgaagactacaatgctcctgtttttctccgtccccgccgtttcgggaaaagtctgctcatctccagccggctcactactacgaccgtacaaaggcgaatcgttttgaagaactcttcggcggtacctggattggcgaacatcctacgaaagagcataatcaatatttggtgattcgttatgacttctcggctatggtgatggcgaatgatatggaaggactggcaaagaactttgacgccttgaattgcagccctgtagaaataatggtgaagcataatcgcgatttgtttggtgattttcaatttaccaattgggggaatgcgttccagatgcttgaggaagctcttgcctatatccgtttgtacggacttcccaaagcctatattctgattgacgaatatgataatttcaccaatcaactgcttacttcctataacgatccactttatgagaaagtgaccaccagcgacagttttcttcgtaccttctttaaagtgataaagaaaggcataggcgaaggtactgtccgtacctgtttctgcacggtgtattgcctatcaccatggatgatttgactatcggttataacattgcggaaattcttaccttggaaccgtctttccttaatatgcttggtttcacctatgaagaaacgaagacatatttgcgttatgtacttgataaatatactcccggtgcaagcgaagaaagtttcgaggaaatctggcagctgattgtgagcaactacgacggttatcgtttcagccccatcggcgaacgtctttttaactccactatcctaacttgtttccttaagaaatttgctgctaatgccggaagtattccgccctaaccgaaccgctgtcggaagatgtggagcaagtgaaaggctatgccgaagacacgaaaaggaaatttcccaattatcatgtccgttcgtatgtagtgtatatctgtgccaacaaaggatggaaatgctgggaagtttagtatgagccatttatgaagtcttatatgggaggttgcaactgtatgttcccgattttttccttcttcatgcggtcaatgagaaataatcgtgtaactttgtaaactgttagtgtaaaaacaagaagagaaaaaatgatagtttgcatagccgaaaagccatcagtagcacgcgatatagccgaagtactcggcgctcataccagaaaagaaggatatatagaaggaaacggataccaggtgacctggacattcgggcatctttgtaccctgaaagagccgcatgaatacacgcctaactggaaatcatggaatttaggtagcctgccaatgattcctccacgtttcggcatcaagttgatagagaatcctacctacgaaaaacaattccacattatcgagggactgatgcagaacgcagatgaaatcatcaactgcggtgatgccgggcaagagggagaattgattcagcgttgggtgatgcagaaagcaggtgcacgctgtccggtgaaacgtctgtggatttcttcattgacagaagaagctatccgggaagggtttgcgaagctgaaagatcagacagattttcagtcactctatgaagccggactttctcgtgcaatgggtgactggctattaggaatgaacgccacccgtctttacaccattaaatacggtcaaaataaacaggtactctctatcggtcgtgtacagacaccgactctggcactgattgtcaaccgtcagttggaaatagctaatttcgaacccaagcaatactgggaactgaaaaccaactatcgggataccactttttccgcacttatccgcaaaagtgatgaagaaattgctgcggaagaagaaaagaacggtggaaaaaagaaaatagataatccgggtatcgaccctatcgctaaccgggaagaaggcgaggcattggtagaacgcataaaggatcttccgtttgtagtcactagtgttggcaagaaagatgggagagagttcgccccacgtttgttcgacttgacttctcttcaggtagaatgtaataagaaattcgcttattcggctgatgaaacgctgaaactgattcagtctctttatgagaagaaggtagctacctatccgcgtgttgatactactttcttgagtgacgatatttacccgaaatgtcctgctatcctgaaaggactccgtgattacgaagtcttgacagctccgttagccggcactacacttcctaaatcgaaaaaggtatttgacaactcgaaagtgacggatcaccacgccattatccccaccggagtctatgctcaaaacctgacggatatggaacgtcgtgtctatgacttgatagcccgtcgttttatagccgtattctatccggactgtaagatttctactactaccgtcatgggagaagtggataagatagaattccgggtgaccggaaaacaaatcctggaaccgggatggcgtgtcgtgtttgcaaaggacgtaaaagatcctactgaagaaaaagaggaagaggatgaaaatgtactccctacctttgtgaagggtgaaagtggtcctcacattcccgacttgaacgagaaatggacacagccgcccagaccttataccgaagcaacactgctccgtgcaatggaaacagccggaaaactggtagataatgatgaacttcgtgatgccttgaaggagaatggtatcggccggccgtctacccgtgctgccatcattgaaacactgttcaaacgaaattatatccgtaaggagagaaagaacctgattgccaccccgacaggagtggagttggtgcagctcattcacgaagaattattgaaatcggcggaactgacaggtatttgggaaaagaagcttcgcgaaattgaaaagaagacatacgatgcccgccagtttctcgaagaactgaaacagatggtttcggaaatcgtgatgagcgtactttctgataatacgaatcgacgtattactattcaggatgcagtagctgcaaaagccgaagagaaagcaaagaaagagcctaaaaagcgtgaacgaaaaccaagtacaccgaaagaaaagaaaccaaaagcggaaaaaacgacgaacgaagtgaaggctgatttgcccggttctccggctccggtggctacaattgcttcaactccttctgcaacaggtggggtagatgcttttgttggccaaccctgtccactttgtggtaaaggaactatcattaaggggaagactgcttacgggtgttcggaatggagaaatggatgtactttccggaagaatttctaatctgtattggaataaattaaatccattggcagtatggttatatttcctgcctcactattgcttttcactgattaattttgtatctttagtgattttcattctttcggagatagatagtcaccttatagaatgacaaatatcaccttataaagtgacattagtcattctataaggtgactattgtcccattgtaatgggacaactacccgagtgcataaaagataataaattcctgcactgaaaaactttaaataatagagacattacctgcatagaaatagtgtatcttacctaatttcatattatatgcctcacaataacaaggtaaagtgcattgtagaaaatagctatgtgaaaaactacatagtttattaaaaaacactatatttgtacacaactctaaatgttctacttataaaatacgactatcaataaattattcagatgaaccgctttattaactactacaagaagatattctcacaagagtacatggatcgcaccatttcgggaggtgtcaagtcacagctcaccttgctactcgttaccattgctacggtgctgactatcttttttattatcgcgatgcttttttccatccaactgcatggacacgaggaatggggagaaagactttgggtggtgtacaataactttgtcgatcccggtaaccaaatagaagagactgcctggcctaacaggatattagtgggacttatcagcatttcgggatccgttttactgggcggtgtgctcatctctaccatctctaatattatagagcggcgtgtgggggtggtatacacagggcgaatgacctaccgtaatataaaaaatcattatgtgctaataggattcaatgaattgtctatcaatatgatacgcgaactgtatgacgaatgtccttcagcacgcatcttgctgatgagcggtatagaggcggcgacagtgcgccatcgtatacagtcggccctacccatcgagatagagagacaagtgcttgtttactttggcaacattgagtcgattgaggaactccagcggttgaacatagagagtgctattgaagtgtatgtgttgggtgatgaagaacgttacgggcgcgatgctaaaaatatcgctattgtgcatttggtgagtgctctgcgtggtaaatgttctgatggcaagatgatgcctgtgtatgtacagttcgacagcatcccttcatattccaatatacagaaaatgaatctgccgcccgaagtcttttgtatagaaggcaagcctaatattttctttcgcccctttaatctccacgaaaacttggcccggcagctatggagcctttatgcagccgattgtgaaaggcgttatgatccgctggattatcgtcccataagcataacgcaacaacctgatggaagttggagcgctaccagtcaagactatgtgcatttggttattgtgggattcaaccgagtgggacgctcgttgctactcgaagcactacgtatctgccattatgccaattatgatgaccgcctgcctgcagatgaacgtatacgtacccgcatcactttagtagatcgcgagatggaggcacaggaagactacttcaaagctcaatttccctatatagagaatcaaatagatgatattgaggtggaatattgccatgacgacatttgtagtactgctatgcgtacccgcctgcagcagtgggcacaaaataagcattgtatgcttacagtggctatttgtgtgcatgatcccgatttgagcctttcattaggactaaacttgccgcatgaagtttatcaatatcagtgtcgtgtgcttatccgtcaggaatttaataatgatttgtcgtcaatggtggacgatgagaagggacgttatcgctatgtcaaagtgtttggcatggtagacaggggaataaagaaaaacatcttacaagacaaactggctttgtatgtgaactacttatacgattgttgttatgctgatgaaagcctcaaacaaaaagaggtattgaagaaaatgtatgaatcctatggcaaccactctgccgactttattttgatgaaccaccaggcgcaatatctatggaataaattaagcgagccgctgcgctgggctaaccgctatcaactagatgcctatagtgtgttttgtcgcacactgggctatggcatcagacggagtaactgctcaccgacacacatatccgaatctatgttcaatgaagaactgccagcccaagttttgtatctgttagtgcgcatggagaagtaccgatggaatgccgagcgtacggtggccggctggaaacgtgctaaggtgaaggataaggtgtttttgctacatcctcttattatgcctttcagcgaactactacaaaggcatcccgaggaggtagagaaggatgctgatgttatttataatttgccctacatattggcattgggaggatatgaactttatagattggccgatcaatagatccatataacattcgtatataacggcacaacatttagatacatgaaaaacgtgaaagtctttattgcttcgtcggcagaacttgatgaagataaattgcagatggacctctacttttcgcagaagaataagggatataggaaacgtgccatctgcttcgaacagcgtacctggcgtgattttcccagctacctttctgaggagcatctgcagaatagatacgatgattacattcgccaatgtgatattgtgatttttcttttccatactcgtttggggcaatatacgctacgcgaactgcaagtcgcttttgaacaagtgaaagcgagtggtggtaaacgtccaaaaatttacatttatgctaaacgcgacgagcatggcgcggcactactggagaaactaaaacaatacagtgagcaagaatatggacacttctgtgatacttatgccgactacaatgagctgtttcatcactttgactatcagttaacgcaactggaaaatgaaggtttcatacgtcccaatcctgtagacttaccgcgtactagacgttttgtactgctttgtttgctgcctgtggtgatagtggctttcttcttgctggcctatcagttatggcaacctgtgacgtttagggtcgaactgaaggagaatatatctaccacactgccctttcggggagctacgctcacactgaagtatgccgatgtagtggaaacccgtgaactggctacgttgcaagaggtggtggaatttgaaggcatcaaccgcaagtatgcttggctcgacgacttcacgctaagtttcaaagctaaggggtatatgcctgtagatactacactaagttacaccaatacttgttttctaagcatctgtcgtaataatgatgctggtgtgctacaaggtgttgtgaccgacgaagaacgacaacccgtggctgatgctcgtgtacaagtgctgggctattctgcacaaactggggccgatggttccttcttgatagaggtaccattatcgcagcaagccactagctatcgtctcacagtgatgaaagcaggtttcgaaatctgggattataatggggtagctccgtcgcctaccgagcggatgcgcatagccttgcgcaaaaaatagtataaccttcaaacaacagtgtactcatgaaaaaactcctacttacagttgcgctatgtgcagctactttttgggttatacgtgcacagagccaacgcggcactgtaatgatacaaaattctggtaaaaaagccttgccgcaagtaaatatagtgatagagggggctacacccactaccagtgatgcgcggggctgttttgaggtacaactacccaatcatatagagggacagcggctacttatacaacagatagcctatcgtgactgggtggtggttaatcaacatatggtgaaccaatgggtatatgcacctaccaaaaactatcgggtagatatgtgtgctaaagaggagtatacggctagagttgagcaattctaccagataggtaaaaccaatgcgaaggctaagtataccagtgccatggctcaactcaaacaactcaaagaggaaggtaaaatgaatagcgaccgctatatgcaacgccggaaagagatacaagcggctctgaacactgcacaagagatgttagactgttatgtacctttgctggtagctatcaatacagactatttggaacctatagaaaaacaggcacaacaactagtgacgcagggaaagctggatgaggctatcggactatacgaaggattacaattggaaaaaagattggctcatgaccttggcttaaagaaacagtgggatgaagatatcgaaagtatgatacccactgttgaacgctatgcacaaacattggtgttacaaggtggtgaggagagttaccggaaggcaggagatttattcaagaagatagctgacagtagtcccacacacatggaccgtaatgccgattacgcaaactttgcttatcatcaacggaattttacagatgcagagacttactacaagaaagccatagagcacagcaaaacaccttatgatttggctgattggtatacgaaactaggccttatctatgatgatatgaaccgtttggatgagagtatcggctactttgacaaagcacaacaattgctcgaaaagttaccgcggaacatactggctacagccgaacttactgtaaaccttgatatcaacttatcgactgtactctttaaaatggtacgtaagggtactcccgaaacaaaattgaaaggttgccgaatagcgctcaattcgctcaaagaggctgtgaagatactattagctttaggtcccacacaggcaccagactacgaatctaagcttatggtctgttatcaaaacatgactactatctatggggtgatgggcgacaagaaagggctggaacaagcccaggcggacattgctaaacttaatatgactgatgctaaagctgatacgcaggtagagtattgggtggcgaaaggaaacaatgccaattataaaaagaaatatgacgagatgttagctgcctatctgaaagctgatgagatcatagagaaattgtatcgtaacaatccttctcaatataaaatagagcgtattactatctatcagttgttagctgctgcctattatgagctggatcgctatgtcgaagcggtggatgctgatgaagaaggcttggctattttcaacactctccccgacgaggagcagagtacacaacgcgaactttattataacctctattacaatctctatcaatgctactattacacccaacagcataatgaggcatacgatgctatcgaaaagattcatcctttcctgaagaccgaggcgtcagaatatgctataaatatatggttcacagcgctcaacgccgcctacaatttggggcgttatgaaatcttgaaatatagtgaagagattattgagaccctgaaagcatgtcaggacaacaaggctgtttattcgcaggtcaatgcttgttatgcctttttaggagcactttttttcaatactgggcatgtagatacagctctttatttttatgatcttagtgataagtgtgctacccagcacggacatgtccgtatgttggcttataataaactcaatcgtctgtcgcttaatctcacaggtcatcgggcacaggaagtcgtagcagatgctcctgccatagaaactgaattgaagaaaagggagggagataacgacagttttgcacagctaaagtatattcaaatgatggcctatatgatgctggggcagtggaacgaagctaatcgtatctctcaactcatgaatcagatgccacctcaagatgctgctgtcggacgtgcccgtgcgctattggcccaggctgtgctatgtatacacactaaacaggaggcaaagccctattttgatcgtttcatgaccgaggcagaggatgcgcgccgctccagtctcttcatgtaccacgaactgatggcagactactattttgtatgcctctactatgctatgcagaataaacaatacaaacaggcttcagagattactgccaaattagctgatgttatgaataatttgaccgaggaatctcctattcgaggcgtttatatgcaaatacagttcctgaacaaatgcggagatttggcttacttcactcaccactatcagaaggctctcgatatatatgaaagtactatctctttattttatgaatatcatgcaaactcaaaagtgcaatgttatacctatatgtatgactgggtgtcgacattactgctagataatgatttttataaagcagagcaaaccatgcgacagatgggaacagcccgtcaggggatcattcagcaggccttcatactagcacttcatgttttacataccgatgtccaagcgggtaaagaactggtggctcatctcaaaactcgtaagttgtataaaagtgaagagttttatgctccggttttattgctttacagtaaacagatgaaggatcgcataggtcaagactatcaacctacactaaatctactcattcagttgttgtcatgagaaaatatttgttgtcatcagttttttgtgggctatgtgttcttggtattcaggctcaagttacactcaaaggagtggctgtgaaaatgaactctgattttactcctgtagcaggagtagaggttgttgtacaaggtggtgtgcctactctcactgatggcgcgggtacttttatactgaaactacctcacatggaatcggacgaccttctttttgatatccgtatcagcaaacagggtatggagatcgttaatctcaaagaggtagagcaatgggtggcaagtggagatatactctataaagtagtactctgtccgaaagggtatattgagcagagcaggcgcaaattctacaacataggcaagagttactatcagcgggagtatgaacgcaaattgcaggaactccgtgtgacacgtgagttgcagcaggcagatattgctacttttgaacaagagatgtcacaactcagtcaggagtatgataagcgtatgaagttgctggattactatgccgataagtttgcacgtatcaacaaggacgagctgtcggccatggagcgacaagctatggcattggtagagaagggagacattgatggtgctatacacatctatgaagcatcgggtattgtggaacaatttagtaacaaaatggcgcaacgtgattcattgcaacagtcattgcaaactacccgtaggctcattaaacagcagttggagtggtatgaaaaagagggaggcagtgtatctcaagaaaaagcgattcagcttaagcaggcgttacaacaactagaggaaaagtacaaactaatgaatagaaaatgaagtaagcactatacaaagattgtgtacttttaatctggcagtgacactaccagccgtaatccataatcaatatcccatcgttgcgggttaactccgtagcggctggtgactttacaatatttctcgaaggtataataactacctccacgcaacactttatgcgtatctttttcgcttataaccggagcgatgtttccggtaaaaggaacctttctgtcataccagtccatacaccattcatatacgtttccactcatgtcataaagtcccagttcgttgggcttcttcgttcctgtttctttggatacgtaagtattgtaatatttttctctaaaccaggcaacctgttctgcattattgctgccggcatagatgaaattcttggtttttagtcccccacgtgctgcatattcccattctgcttcgaaggggagacggaagggtagaccgcttaattgagaaagtttttgggtaaatcgttgagcgttgaaccaattgacttggtctaccggatagttacgtctgtgttggttagaaggattttctcccataatgacataccattcatcctgactaacttcatatcggttgatgaaaaaagaggctacatccacgggatagttgttgttgtctccgagattggctgtaccaccttccacataaaccatattccatagtatatagcgtataacctctttttgttctttatttattgtcggcgaccaatgcaaggctttttccaatttggaggggagagtgtcaataatacttgcttctcttcgacatttatcgtggtatcgttgccacatttgttgttcttgcgctctgcttgataatgcgattccttgtaatagaaagcaaatgattatagtttgtttggtgtacccttttatcatgataattgtatgtttatttattggacgaactaaagtagcaatgactgcaatagtaacacttaaatttatttaatatttttcgctaagaaatgatctttgtgatgataaccctcatacgttgaaaacccaaaatttcttcctgcattgaataaatgcctttttttcattaaaatcctctttcttttaggcaataatcgtggcgcgtttgttatttataaataagaagatcaattatttaaatagaatgaacatgaagaaaaaattagcaggagttgcattggtgttggctgccgtctctttgatgagtatacagcctgtagaagcatgtacgcgtgcagtgtatataggccctgaccagatggtgataacaggacgtacaatggactggaaggaagatatcatgacgaatatctatgtatttccgcgtggtatccaacgtatgggacataacaaagagaaaactgtgaactggacttccaaatatggaagtgtgattgctacaggatatgatataggtacttgtgacggaatgaacgagaaaggattagtggctagcctgcttttcttgccggaatccatttactctcttcccggcgatacccgtccggcaatgggcatcagcatttggacacagtatgtgcttgataactttgccacggtacgcgaagcggtggatgaattgaaaaaggagactttccgcattgatgctccccgtatgccgaatggaggaccggagtctaccttacatctggccataaccgatgaaacaggcaatacggctgtattggaatatctggatgggaaattaagtattcacgaaggaaaagaataccgggtgatgacaaattctcctcgatatgaacagcagttggccattaatgattactggaaagaaatcggtggcttacagatgttacccggaaccaatcgggcaagcgaccgttttgtacgggcttcattctacattcatgccattccccaaattgcggatgcaaagattgcagtttccagcgtattgagtgtgatgcgtaatgtttccgtgccatttggtattaatacaccggagaagccttatatatcttctacccgttggcgttccgtatccgatcagaagaataaggtatattatttcgaatctaccctgactccgaatttgttttggctggatttgaagaaaattgattttagtccgaaagccggcattaagaaactgtctctgacaaagggcgaaatttatgcaggtgatgcagtgaaggatttgaaagacagccaatcatttaccttccttttcgagactccggtcatgtaatttgtcagtgtgatagatatataaaagagtggtggacaaatgcttgtaatcaagcttgttcaccactcttttatatgtatcgtttataacttgattgttatttatccgctttatcgtctggcatattcctgatgaaactctatgactgcctctatccctttccggaagatatccaatgagcagttctcgttcggagaatggatcgcattcgattcgagtccaaatcccatcaatacggttttgattcccaatacctgttcgaaagtagagatgatgggaatacttccgccacggcgtaccgccaacggctttttcccgaaagcgatctcgaaacctttctctgctgcctgataggcaggaagtgaaatcgggcacacatatccttgtcccccgtgcatgggagtcacttttacctgtactgtatcaggcgcgatactaagaatataatctgcgaacatttgcgaaatcttatggtgatcctgatgcggtactaaccggcaagatactttagcataagcctttgaaggcagtacggttttagaaccttctcctgtatatccgccccaaatgccacatacgtcaaaagacggacggcaactgttacgttccaatgtgctatatcctttttctccgaaaagctcttttacaccgattgcttctttgtatttcttttcgtcaaaaggaatatgggctatcatttcccgttcggtttgcggcacttcttccacatcatcgtagaatccgggaacagtgatacgtccgtcggcatccgttactttgctaataatctggcaaagcgcgttgatcggattggctaccgcacccccgaaatgtccggaatgcaagtcacgattcggtcccgtcacttctatttcccaataagccagcccgcgcagaccagtagtcaatgagggcagttcagctcctagcatactcgtatccgacaccagaataacgtctgctttcagcaattctttatgttcttcgcagaaagcttccagactgggtgaacctatttcttcttcaccctcgaagatgaacttcacattattcttcagtaatccgtttttgacgagatattcaaatgctttcacctgaatgaacgattgtcctttgtcatcatccgctccacgtgcccagatatgtccgtcacgtatttccggttcaaacggttcgcttttccagagttccaatggttcggccggcatcacatcgtaatgagcgtagattaatacagtctttgcatccgggttcacgatcttttgagcgaaaacaaccggattgccctgtgagggcattaccaatgcttcgtccacacctgcttccaataacagttgtgcccagcgttccgcacaagccagcatatcgtcgtggtgctctggcagagcactgatactgggaatgcgaataaggctgaacaagtcatccatcatctttggttcgtgtgccgctatgtatttctgaatctcgttcattagagttgcgtcgttttatccagtaagtaataatcgagtatggtcatggcagccattgcttctacgataggtacggcacgaggtaatacacaagcgtcatgacgtccgcgtgctttcagagtggtgtcgacgccatcaatgttgacagtttcctgttccatcagcagcgtggcaatcggtttgaacactacacggaaatagatatcctgaccattactcaatcctccctgaatacctccggagtgattggtgtgcgtctcgatccgtccgttattgttatagaaaacatcgttctgttcggaacctttcattttcaatcccttgaatccttcaccgtattcgaatgctttggcagcgttgatgcttaacatggcgttacccagggcagcatgaagtttaccgaaaacaggttgtcccaatccgatggggcatcccttaatgacacaggtcagtgtacctccgatggtatcgccttcaccttttaccttatatataaggtctgccatttcttttgctttttcagggtccggacaacgtacatcgttggtttctatcaggtcgaaattatagtccgagtaagtaccctccagtttgataggacctacctgcgaggtataggcagtgatgttgactcccaattggcggagtgccagcttagccaatgcgccggctaccacgcgcgaaatcgtttcgcgtgcggaagaacgtccgccgccacggtggtcacggattccgtacttcactgtgtacgtgtaatcagcgtgtgaaggacgatatacatttttcagattgttgtagtcattggagtgttggttttcattccaaacgataaaaccaatagggcatccggtggatttcccctcaaaaatacctgaaagaaactcaactttatcagcttctttacgtgcagtggtaagaatggattgtcccggacggcgacgattaagttcttgttgtacaaattcttcgtcgatgacaattcctgccggaaatccgtcaatcactcctccaactccttttccatgagactcaccgaaacttgtgagccgaaagatattgccaaatgaattaaacatagttgtggcttttttaaaattactatatgcaaatataacaaagttttcgataagaaagttgtgaactcgaaatatcttcgaaaaaggaagcatattgaactttttttcttctttttagtttataagggacgaatttattataataactaaaccaaagacgtatgaaaaagaatctattgtatttattggcattggtctgctctcttactttctttgctgcttgtagcagtgacgatgacgacagtgataacaaggataatgggaatcctcctgaagaggaagctgtgataacggctccggatgtagtcggaacgtattggggaaatctggatatatccatgataccggatggttctgaccaggaaattgtcataggagatggaatagagaagtttattaccctatcgcaggtcagcaatacggaagtgaagattgaactgaaggagtttgaattgttcatcaatcaacagattctgaagtttggagatattgttgttgataagtgtgaagtgaagaaaggggaaggtgtgtctacatttaccggacagcaagaccttacgtttgagggaaatgccgctgctttgggtacttgtcctgtaactgttacaggaacggtagaagatggaaatgcagacatgaccattaacgtgaaagtgcctacattgcaacagactgtaaaggtgacctactccggagtgaaacaggtggcagagtctggtggaaattaatttcttgttcaccacagattacacagattatttatattgatagtctatgacttataaatcaatctgtgttaatctgtgtaatctgtggtgagacttaaaatgcgtacccaaaacctatattcaaatagataggatacattgcaaaagtgattgtattaaaatcgcttttaaatatatcgttcaatccccaggtgagatcagcatacacattgaggtgcttgaaagctcgccatccggctcccacctgtaatccccactggaaatgtctcaagtcgtccgagaaatcgtaggttgcaattttgtcgtcggtaaattctactttcggaccggtgggatcatcttcccgcaaatatccttcgtacacatgacctgaaaattctcttgaaagcagatacgagaaataaggtccggctttgatgttccatcggttacttagtttgtaggtagccattagaggtatagttagtccggcggtatgtactttggttttcactccgcccgtccatactccgctgattctttcacctccttgtccgagaatttccatattgtaattttttacggtggcttcggtggtcattgctttgttttcgagccggagtccgactatgatcccgagtttgttctgaacggcaatccatttggttacttcgccccctatgctgatggccagtgtcgggttatatccgtcaatcgaacggatttctaccggaaggggaagcggggctgtgccgccaatgctgaaacctgctttgatttcatattccagtccgtgaagggcggaacggatcagtgtttcatttcggtctacctgtgaatagccggggagagctattcctatacaggctagtaaactgaatatatacggatagattcttatcattatgattgttataaagttatttaattccgttcgtttgataatgtgcacgttttgtatgagtacattgcttgagcgcattatcagcgtattgctatgggaaattcttcttcgaaatcccgctaattttccgagcgatagattaactctgcctcgtcgatcagtaatgtacttccgattgctccgttaaaatgatctccttccaggcttgaggtgaacacgatggctatattatatttcccatcccttagcttctccttatcaatgaattttccggggagagtgatgaaaggaagtttaaagtaagtccattcgttcgtttctttggcattattaatccgtgctgttgaaatcaggttcggactggtgaatgcattcgttccgtcaagagtaggaacagattcgctggtttcgtacatgatggcatatatgtcacagatgtcccgtttcccgttcactggctttcctccttctgtaaactgatctcccgctttgtatttataataacctgccagataagtgggtacatgccggaaagggaggccgaatttggttgctttcagaggattgctcatagcgttattcacatcgaaagagccgataaacagatttcctgccgcaataggcattcctgctatctggccgaagaatccggtactgcgtgtcactaaggagaggcatttgccggcttttccgtctgttatttggaaagtgggataatcatcggctgttttagctactccggtcatggcataacccgcatttccgctggcccattccatgacgaccttatctccttcgcgttccacaaatatatagtacttctttccgcccagtgtatcttcgaaattatagttcgtggcaagttccgtgtcgatcactgatacggtatacattttcttccaaacaccatcggcagctgtgacagtatattcctgtggggtattgaagtttcgttccgtgccgctaagcggactgatcgcagctcccggagtcagtgtaaattcaggcttgagttctgaaatatcagttcccggaccaacaaagatagttatggaattattgttaataataggactggttgtcatggctactcccggtagtatacaacttaatatgtctgcttctgcattgagagcttcttcgcggatacatgaagaggaaacaatagctagtagcaaataaacaactatgtgttttgctttcatttttctatcaattctttctgttaaagtttggtgtatgggaggttttataacaatatgagattttatttgttcattatagaatgttggaaaagaaagaatttcctatttttgtggaaccaaaacttataagtccatgactgaatcagaaagaaggcaaattatagaattgattaagaaggaggtcattccggctatcggatgtacggaacctatcgcagtagcgctttgtgtagctaaagctgccgaaacactgggagcgaaaccggaaaagatagaagtcctgttaagtgctaatatattaaagaatgccatgggagtcggaataccgggaacgggtatggtcgggcttcccatagcggttgctttgggtgcgttgattggcaaatcagattatcagttggaggtattgagggattgtacgccggaagcggtggagcagggaaaacaattcatcgcagaaaaacggatttgtatttctctaaaagaagatattacggaaaagctgtatatcgaagtgatttgtaaaacggaagataaaacggctaaagccatcattgccggtggacatactacctttatatatatagccaaaaatgaacaaacgttgctcgacaagcaacagacagtcagcgaggaagaggaagaggcttcgcccgaactaaacttgcgtaaagtatatgactttgcactgactgctccgctggatgaaatccgtttcatccttgacacagcccgtttgaacaaagctgctgccgagcaagcctttaaaggtaactacggacattctttagggaaaatgcttcggggaacttatgagcataaagtgatggggaatagcgtgttttctcatatcctctcttatacgtcggctgcctgtgacgcccgtatggccggtgctatgattcctgtaatgagtaattccggcagtggtaatcaggggatatccgctacacttcctgtcgttgtctttgcagaagaaaacggaaaaagtgaagaagaactgatccgtgctttaatgcttagccatctcactgttatatatatcaaacaaagtttgggacgtttgtctgctttgtgtggttgtgtggtagctgccacaggttccagttgtggaatcacctggttaatgggaggaaactacaatcaggttgctttcgctgttcaaaacatgattgccaatttgacaggaatgatttgtgacggtgcaaaaccgagttgtgccttgaaggtaaccaccggagtttcgacagccgtactgtctgccatgatggcaatggaagaccgttgtgtgacttccgtagaaggaattatagatgaagatgtagaccaaagtatccgtaacctgacaagaatcggctcgcaagccatgaacgaaacggataaaatggtacttgacatcatgacgcacaaaggatgctgattttaagtattaagtatcaagtattaagtattaggcattaagtattagccggaatgacggcataaaaaaagtattaagtattaaaactccggttatatccgcacggaattaatacttaatactttatacttaatacttcaattaatgacagtgtccgccttcgcaaccgcagtcgtcgccacagccatcaccgcagctgtcgcatccgcaaccgcaaccaccttcgccactcatcattttcaccaattcctggatttcttcgttagtagcaggacggctttccagtatttcaccttcgaaaatcaggtcggcaccagccaacgggtgattgaggtcaactactacaacatccggtttgatttctactacgctggcatttacgcgctgaccgtcgccagtcatcaaaggtacgatgttaccttctttaatacgttcgctatcaaacttgccatctatttcaaaaatatttttggggaggtcaataacgtgttgttcgtcatattgtccgtaagccttatctgccggaatggtaaaatcaaatttatcacctttagaaagagcagttatctgattttcgaaatcttcgagtgttgttcctaatcctgaaatgaattgaaagggatgttctgcttttgcttcttcgaacaactctttttcaccatcttccattgtatatagtttgtatgcaacggtaatgtacttgttttctactgtttccatctgatcttttttgtttctgattaataattcccgtaaatacgggtctacaaagatacgaattatttgcttgtactccggtatagggagggtaaatttcagattattaagtgcttttgtcagaaaaagaaagtgaggcgcgcagttagataatagttgtaaattcaacctttaagtgataaaatagagaaataatacctctcttttcttacaattattcgcttttaagtgatttttttcttcgatttgtttggatataataaaaaagcccttacctttgcagcacgaaaataaagaaaagaagatatgaatatgttacatacatctattaacctagcagtcctgcatattattcgcgtcgtggtggtcccatcaagagcgtgagaaaggtttttgtgttgtatgtgttcgtaccataaaagatagaatttagagcctttctcacttgtgtgaggaaggctctttaattaaaagatagattgaaatgaaaaagcaattacgcagttcgtttagtacacaaggccgtcggatggcgggagcccgtgcattgtgggcagccaacggcatgaagaagaatcagatgggtaaacccattatcgctatcgtcaattcgttcacacagtttgtcccggggcatgtacacctacatgaaatcggtcagctggtgaaggcagagattgagaagctaggatgcttcgctgcggaattcaatacaatagctatcgacgacggtatagcaatgggacatgacggtatgctttattcgcttccttcacgtgacatcattgcagacagcgtagaatatatggtcaatgcgcacaaggcagatgcaatggtatgcatcagcaattgcgataagatcactcccggaatgttgatggcggctatgcgtctgaatatccctgccgtatttgtatcgggtggtccgatggaagcgggagaatggaatggccagcacctggatttgatcgatgcgatgattaaatcggccgacgaaagtgttagcgatcaggaagtagcgaatatcgagcaaaatgcttgtcctacttgcggatgctgctccggtatgtttaccgccaactcgatgaactgcctgaatgaagcaatcggactggctcttcccggcaacggaaccattgtagcgacacacgaaaaccgtacgcaacttttcaaagacgctgcggaactgatcgtgaaaaatgcaaaattatattatgaagaaggagacgaaagtgtacttccccgtagcatcgctacccgtcaggctttcctgaacgccatgacgctggatatagcaatggggggatctaccaatacggttcttcacttgttggctgttgctcacgaagcagaggtagacttcaagatggatgatatcgacatgctttcccgcaaggctccttgcctctgcaaggtggctcccaatacacagaaatatcatattcaggatgtaaaccgtgccggtggtatcattgccattatggacgaactggcaaagggcggtttgatagatacatccgttcgccgggtagacggaatgtcactggcagaagctattaatgaatattcaatcaccagcccgaatgtgagcgaaaaagcaattaagaaatattcgagcgcagccggaaataaattcaatctcgtacttggttcacaaggtatgtactataaggaactggataaggaccgtgcaaacggatgtatccgtgacttggaacatgcttacagtaaagacggcggactggccgtattgaaaggcaatattgctcaagacggttgtgtagtaaaaacagcaggtgtagacgaaagtatctggaagtttaccggacctgccaaagtatttgattcgcaagaagcagcttgtgaaggcatcctcggaggtcgagtcgtcagtggagacgtcgtcgtcatcacgcacgaaggtccgaagggtggtcccggtatgcaggaaatgctttatcctacctcttatataaaatcccgtcatctcggaaaagaatgtgctttgattaccgacggacgtttcagcggtggaacttccggattgagtatcggacatatttctcctgaagcggcagctggaggcaatatcggaaaaattgtagacggagacattatcgaaatcgatattccggcccggaagattaacgtgcgactgacggatgaagaactggcagcccgtccgatgactcctgtcactcgtgaccgttatgtaccaaagagcctgaaggcgtatgccagcatggtaagctctgccgataagggagcagtgagaattatataatatagttggtgatagttgataggtaatagttagctgcgcagcacttagcgcaatgattgtaaaccattcattttcaactgtcatttctcaactatcatttatcatttatcaactatcaactaatatgaaagatttaataacaggtgcagaggctttgatgcgctccttggaacatcagggagtgactaccatctttggttaccccggtggctctattatgccggtattcgatgccttgtacgatcatcaaaatatattgaaccatatcttggttcgtcacgaacagggagctgcccatgccgcacaaggttatgcccgtgtatcgggtgatgtaggtgtttgcctggtgacgagcggtcccggagcaaccaatacggtaacaggcattgcagatgcgatgatcgatagtacgcctatcgtggtgattgccggacaggtaggaacaggctttcttgggacggatgcttttcaggaagttgacttggtaggtatcacccagccaatcactaaatggagttatcagattcgccgtgcggaagatgtagcctgggcggtagcacgtgcgttttacattgctcgtagtggtcgtccggggccggtggtactggactttgccaaaaatgcgcaagtagagaaaacgaaatacgaaccgacgaaagtcgattttatccgtagctatgttcctgttcccgatatggacgaggagtctgtacaggctgctgccgaactgattaataacgctgaacgtccgcttgtattggttggacaaggtgttgaactgggaaatgcacagagcgaattgcgcgagtttatcgaaaaagcggatatgcctgcgggttgtacgctgctcgggctttcggctttgccgacagaacatccgttgaataaaggtatgttgggtatgcacggcaatctgggaccgaatatcaataccaataaatgcgatgtgctgattgctgtcggtatgcgttttgacgaccgtgtgaccggtaatttggctacttatgccaaacaggcaaaagtgattcattttgatatcgatcctgcggaagttaataagaatgtaaaggtagatgtagctgtattgggagattgcaaggaaacactggcttctgtgacgaaactcctgaaaaagaacactcataccgaatggattgatagcttcaaagaatatgagaaagtagaggaggaaaaagtaatccgtcctgaacttcatcctgccacaaactctttgagcatgggggaagtggtacgtgcggtaagtgacgctactcaccatgaagctgttttggtaacagatgtaggtcaaaatcagatgatatctgcacgttactttaaatatacgaaagaacgcagtatcattacttccggaggacttggaacaatgggcttcgggcttcccgcagctatcggggcaactttcggagcaccggaacgtaccgtatgcgtatttatgggagatggcggactgcaaatgaatattcaggaactgggtacgattatggagcagaaggctccggtgaagattatctgcctgaacaataattacctcggaaacgtacgtcagtggcaagctatgtttttcaaccgtcgctattcgtttaccccgatgttgaatccggattatatgaaagtggcctcggcttatgatattccttccaagcgtgttttcactcgtgaagaactgaaggaagctattactgaaatgctggcaacggacggaccgttcctgctcgaagcttgcgtggtggaagaaggcaatgttttgccgatgactcctccgggtggttcggtaaaccagatgttgctggagtgctaggagaagttgagagttgagaatggagagttgagagttcgcatttaaaaaattagagttatgagtgataaaacgttatatacaatcattgttcattcggagaatatagccgggttgctgaatcaggtaactgctgtatttacccgtcggcaaataaatattgagagtctgaatgtatctgcttcttctattaaaggtgtacataagtatacaataacagcctggactgataaggacatcattgagaaggtagtgaaacagatcgaaaagaagatcgacgtgattcaggcacattatttcacagaggatgagatttatttccacgagattgcattatataaggtgtctactcctgcttttcaggagaatccggaagcatccaagctgattcgtagatacaatgcacgtatagtggaagtcaatccggtattttctattgtcgagaaaaatggaatgagcgaagatataacttcgctctatggtgaactgaaggctttgaattgtgttttgcagtttgttcgttcgggacgtgtagcgattactaccagctgctttgaacgggtgaatgagtttctcgatggacgggaagctatgtataaccaaagtaaaaaccaataagaataatgagtgaagaaaatagaatagggacttatcagtttgtggcagaaccgttccatgttgacttcaacggacgtttgaccatgggggtactgggaaatcatctgctgaattgtgcaggttttcacgccaatgaccgtggttttggtattgcaacgctgaatgaggacaattatacatgggtgctttcacgtctggctattgagttggatgaaatgccttatcagtatgagaatttctcggttcagacgtgggtggaaaatgtctaccgtttgtttacggaccgtaattttgctatcctcgataaggatggaaagaagattggctacgcacgttccgtatgggcaatgattaatcttaatacccgcaagcctgccgacttgttgactttgcatgggggaagtatcgtagactatgtctgtgatgagccttgcccgattgaaaagccttcacgcatcaaagtgacaagcgatcagccgatagctaccctgacggcaaaatacagtgatatagatatcaacggtcatgtaaacagcatccgttacatcgagcatatccttgatttgttcccgattgaattgtataagaccaaacgtatccgtcgttttgaaatggcgtatgtggcggaaagctattttggtgatgaactctctttcttctgcgatgaagtgaacgcaaacgagtttcacgtagaagtgaagaagaatggcaatgaagttgtttgccgctcgaaagtgatatttgaataaatgtgagaatataaaatcaattaataacacagatggcgtaagtcatcaaaaactaaaaacaaaaagaaaatggcacagttgaattttggaggtactactgaaactgtagtaatccgtgacgaatttccattggaaaaagctcgtgaagtattgaaaaatgaaacaatcgctgtaatcggttatggcgtacagggtcctggacaggcactgaacttgcgtgataacggtttcaatgtaatcgttggtcaacgtgaaggaaaaacatacgataaggcagtagcagacggatgggttccgggtgaaactttgttcggtatcgaagaagcttgtgagaaaggtactattgtaatgtgtctgttgtctgacgcagcagtaatgtcagtatggcctactatcaagccttacctgactgccggaaaagctctttatttctcacacggttttgctatcacttggaacgaccgtacaggtgtagttcctcctgctgatatcgacgttatcatggttgctcctaaaggttcgggtacatctttgcgtactatgttcctcgaaggacgcggcttgaactcttcttatgctatctatcaggatgctacaggcaaggcttacgaaagaaccatcgcactgggtattggtatcggttccggttatctgttcgaaacaactttccaacgtgaggctacttctgacctgacaggtgaacgtggttcattgatgggggctatccaaggtttgttgctggcacagtacgaagtattgcgtgaaaacggtcatagtccttctgaagcattcaatgaaacagtggaagaactgacacagtcattgatgccgttattcgcaaagaacggtatggactggatgtacgctaactgctctactactgctcaacgtggtgctctcgattggatgggcccattccacgatgctatcaaaccggtagttgaaaagttgtataatagcgtgaagactggtaacgaagcacagatttctattgatagtaattcacaacctgattatcgtgaaaagttaaacgaggagctccgtcaattacgcgaaagcgaaatgtggcagactgctgtaactgttcgtaaacttcgtccggagaataattaattagaccagattatacaagttttaaaagaaggagagagctttttgctttctccttcttttattaataagatatttaaaaatgggtaggtgaagcttgcagaaacttttttttgaaaaatatatcaataatgtgattaaaatatgcaagtttatgtttatatttgcactatcaaataaaatgaacgagaagtatgatgtgttttaacttaccccaaagaatgattaacattgctaaattagcatgtgttatcagtgttgtttctgttgctttctcaagctgtttacagaaagatgtatatgatcctgctaattcaggagataaagaagaagttactttagataactatttcgactttgccactactaaaaatattcaattgaatattgattatggaaaggaatgtcctagggcttattttgaagtttatgctgaaaatccgctttcttatgtggcagaaggcggtcagattataaagaaagcaggggtgtcacacattgcaaccggatttacagatatacaaggacgttatatcaaaccggcttctttcccgacagcagtttcagaagtttatatttattctccggattttggtgtgccgactttgtataaaactaaagttgtcggttcggatgtcagcgcaaaaataaccttcgagaatgttcttgatgttactcctgtggattcatcaacgagaagtgcacaaacaagggctgcggtgaaatttattacagatgtaatcccgaacgtattaggaacttggaatgcaaattcaggtaagcctgactatttggatgcttctaagaagatcaacgtggatgcaactctcaagagttatataacgacatattttccggaaggaaagaataacgtaggacctttagttactgataatgctgatattctgataaaagaagatgcaaatgtcgttattaactattttgggggagacacaggagcgaaaagtgtatttgcttattattgctatccgaaagatgcttctactgatgaaataaggaaggcaacaaagcatgcatgtgtcatatttcctaacgcacatggaaatagtttaggttattatagtggggttgcagttaatttaaaatatataaatgagactggtaatttccctcaaaaggacccggaacgtattccggcaaatacaaagattggtttcttgatatggaataatggctgggtaaatgccaaggctaatgggaatatgttctactcaaccaaatctttgaatagtgacaaaatttctcacactgcaatttttgcagcaaaaaataaagcaggtgatagagtgaatgttatcactatggaagactggaaaaacggtgaaaatgactataatgatgttgctttcgttatctcttctaatcctattgctgctattgaagttccggatgttcctaatccgggtgatcgacaaggaacagaaatgtattctggagtgcttggctttgaagataactggccggaacaaggagattatgacttgaatgatgtagtcatgaaatatcagtcaagcgttgattataatatagataataaggttcttaatattattgataagttcaccttggcttggacgggagctaattataagaactcgtttgcttatgaagttcctttcgatttgagtaaagcttctaaagtaacggttaatggtagtgaagcttcttcctattcaggtaatgtgataacattattcaaggatgctaaagctgaattgggagtatccaatgtgaatgcggaggatatgattaatcagaatattcaagagaagacatatacggtatccatacaatttaataatcctactcttgataaatcagtggtggtagctccttataatccttttataaaagtattcaactctgccacagaagtccatctgacagatcataagccgacgactggtgcgaataatcgtttcccttccggagctgatatttctcgtggtgatgtagatggtacctatttcatttgcaaagatggttttccgtttgcaattcatgtagatgctcgtttggatgcttctattttgaatttagatcttaaaaaggagaatcagcgcattgataaaacatatcctaaatttgcagaatgggcaaaaacgcgcgatccgcaaataaaatggtggaaatagttggagtgcattagaataatcgactatctttgaggatgaaaaattaagaatagtactgatgtaaaatattgtttgttttgtttgtgttaaaaaaagtgtggtttcgggagaaagtgtgctttgttaaaaggaggattaagtatttaatcctcctttttaatgaataacatcaatcttttatagaaaggatgtttggtaagggtggaggcatctcctaatataacaagcttcattcgtgcccttgtaatcgctacattcattcttcgcaaatcattcaggaatccaatctgtccatcctcgttggcacgtacaagactgatgaaaataacgtctcgctcctgtccctgaaagccgtctaccgtatttacggtgatgaggctgcggaaagggcgtaaaaagctgcttccttttatttttcctctcaaatattgcacttgtgccttgtatggcgaaatcagaccgaaatcaattctttcatccagtattcgctttttgccgatacgttcgatgtaagtttccagttcttgcagtaataggttagcttcctgcttattgatgcgtccgaaactttcgcctacaaagtcttcgtgaaagtccatctctgaagtatcgatccagttcatgggagtgtcgaaatcaagaatcccccgatagcgtacttccggagcagcttccagttctccatgataaaaccagtcggagggaaactgcatgatggcttcatgcattctgtactgtacttttagtaaagaaaccgcagaaggtttttgctgaacgactttttccattaatgtatgatccaatcctccacgggaggcttctatacatttgatagtcggcggaagttgacaatgatctcctgcaaggatgacccggtctgctttgcggatagcgatccagcaggcagcttcgagggcttgtgcagcttcgtcgatgaataaagtcggaaaacgacgtccgttgagcaggcggtggttgctgctgactagggtagaagcaatcacgcgggcactgtcgaaaagatcggcattgatttgtatttccaactccgtggcgcggtcgcggagacgactcatgcgattacgcattccttcccgttcagaataactaccccggcgcatccggctacccatttcgcggatagatttacgaattccccaaagctccggataggcaggatgactttcaaaccggcgttcgtaggtggatgaaagcattttgtcgttgactcgggttggatttccaatgcggagcacggctactccccggtctaccagtttctcacaaatccagtcgacagccgtgttgctttgcgcacagacaagcacttgtggttcccggtgtaacgtttcgtaaatcgcttcgacaagagtcgttgtctttccggttcccggaggaccgtgaacaatagatacgtcacgcgtacagagcaccttgttaacagctgtttcctgtgtactgttcagccatgggaagcggacaggatataattcgcggaatcccggcttttgggtacccaacaaaatgtcgcgcagttccgctaggcggttgtctttggcgcgtatcgtgtcttctagtgcctcgaacatggcccggtacgatgtttcgtcaaaataaagttgtactcccagtataccgtcagtttgcagttccgctaaagctcccgctccggggagtacaacgaccattcgttcttcgtcggcaaagctgacggtagcgatgaaatccatatatttcacttttccttcgaatgactggtggaaaaagcaaacaggacggccgaactcaaaggaatgctctatttctttattttcggtccgtgtaatatctattacaagctgattcagcgaattgtagtaacttcgaccaagagagacaggataccagcagagaccgcgcttcactttacgggcaacgcccattgtttcggtctgccgcttaaattcttccttctcatattcatactccatccgcaggaggagttgctgttgctgaaggtctataatgggacttttcggattattactcataataggcgcaaaggtaacaaatcttcgttccgggtagaaaaaatatttcattttgttaaacattactcgaacgtcgttcgttattttaatagatagactaaaaaaacaaaaagcaatatggtatatgatgtgactatgttagaagctttctacgctgcttataaaggaaaggtagaacacgtacgggctatactgaaacgccctttgacgttggccgagaaaattttgtatgctcatctgtatgatgtagccgatttgaaagattacaaacggggggaggattatgtgaatttccgtcccgaccgtgtggctatgcaggatgcaactgcgcagatggctttgcttcaatttatgaatgcaggtaaggatcaggtggctgtgccttcgacagtacattgcgatcatttgatacaggcgtataaaggtgcaaaggcggatattgctacggcaagactgactaatgaagaagtatacgacttcctccgtgatgtatcttcccgttatggcatcggcttctggaaaccgggagcaggaattatccatcaggtggtgctcgaaaactatgctttccccggcggtatgatggtgggaacagactctcatacgcctaatgcaggcggactgggcatggtggctatcggtgttggtggcgcggatgctgtggatgtgatgacaggaatggaatgggagctgaaaatgccgaagattatcggtgttcgtctgaccggaaaactaagcggttggacctctccgaaagatgtaatcctgaaattggccggcatccttaccgtaaaaggaggaacgaatgctattatcgaatattttggtcccggaactgaatccctttctgctaccgggaaagctaccatttgcaatatgggtgccgaagttggagctactacctctttgttcccctttgacggacgcatggctacttatttgagagctaccggaagagattgtgtagtcgattgggctgaatctgttggtgcagaccttcgtgcagacgacattgtgaccaacgaaccatccaactattacgaccgtgtaattgaaatagacttgtcagaactcgaaccttatataaacgggccatttacaccggatgccgctactcctatctctgaatttgcagaaaaagtgttattgaacggctaccctcgtaaaatggaggtgggcttgataggttcatgtaccaattcttcttatcaggatttgagccgtgcagcttctctggcaaagcaggtgacagaaaagaatttgagcgtcgcttctccgctgatcgtcaatccgggttcggagcaaattcgggctactgccgaaagagacggcatgattgaagcttttgaacggctgggagccacgattatggcaaatgcttgtggaccttgtatcggtcagtggaaacgtcagacggacgatccgacacggaaaaactcaatcgtcacctcttttaaccgtaattttgccaaacgtgctgacggtaatcccaacacctatgcgtttgtagcttctccggaactaacgatggcgttaacgatagccggtgatctctgtttcaacccgttgaaagacagattggtgaatcataacggagaaaaagtgaaactctccgagcctgtaggagatgaacttcctttgaaaggttttgaacagggaaatgagggatatattgccccccacggagcaaaaacggaaatcagggtaaaaccggattcccaacgtctccagcttctgactcctttcccggcatgggacggacaggacttgctgaacatgcctttattgattaaagcacagggaaaatgtactaccgaccatatctctatggcaggtccgtggctccgcttccgtggacatttggagaatatttccgacaatatgctgatgggagctgtcaatgctttcaatggtgaaacgaaccgtgtttggaatcgttcgacaaatacttatggaacagtttccggtacggcaaagatgtataaatccgaaggtattccgtctattgttgttgccgaagagaattatggagaaggttccagccgtgaacatgcagccatggaaccacgcttcctcaatgtacgtgtcattttggctaagagttttgcccgtatccacgaaacaaatctgaaaaaacaaggaatgcttgctcttacttttgtagataaagcagactatgataaaattcgggaacacgatcttctgtccatatcaggcttagtccatttcgcaccggggcgcaatttgacgattgttcttcatcacgaagacggaacgaaagaaagttttgaagtgcaacatacctataatgaacagcagatagcttggttccgtgccggttctgccttaaatgcaagataaaaaatgagcaaaataaccatgcaaacagatggtacgctgttggtacccgatgtgcctaccgtaccttatattaccggcgatggagtaggagccgaagtgactcctgccatgcaagccgtagtggacgcagctatccggaaagcatacggcggcaaacgtcggatcgaatggaaagaagtgttggcgggagaacgttccttcaacgcgactggttcctggttgccggatgaaacaatggaaacttttcaggaatacctggtaggaatcaaaggtccgttgacaactcctgtcggaggtggaatccgttcgttgaacgtagcactgcgtcagacacttgatttatacgtctgtcttcgtccggttcgttggtatcagggagtacagtcgcctgtcaaatcaccggagaaagtgaacatgtgtgtgttccgtgaaaatacggaagatatttatgcaggtatcgaatgggaagccggaactccggaagctgaaaagttctatcaattcctgaaagacgaaatgggcgtgacaaaagtccgtttcccggaaacctcttctttcggtgtgaaacctgtatcacgtgagggcacggagcgtcttgtgcgtgctgcctgccagtatgcgctcgaccatcatttgccttccgtaacgctggtgcataaagggaatatcatgaagtttaccgaaggtggtttcaaaaaatggggctacgaactggcgcaacgtgaatttggcgatgctttggcagatggcagactggtgataaaagattgcattgcggatgctttcttacaaaatacactcctgattcccgaagaatattccgtgatagccaccttaaacctcaacggagactacgtttccgaccaactggcggccatggtaggcggtatcggcattgctccgggagcaaatatcaactaccagacaggtcatgccatctttgaagcgactcacggaacagctcccaatattgcgggaaaagatgtagtgaacccttgttctataatcctttcggcagtaatgatgctcgaatattttgactggaaagaagcggctgctctgatagagaaagccttggaacaaagcttcctggacgctcgtgctacacacgatttagcccgttttatgccgaatggaacctccctctctacttccgctttcactcgtgagatcgtggaaagaattgaaaaacaaaagtaacgaataaaaaacgaagaaagatgaaaaaagagtacttgatttacaagctttccgaggaaatgaaggaagctacccggattgatacagaattgttctccaagtttgatgtgaagcgcggattgcgtaatgaagacggcacaggtgtattggtaggtttaaccagaatcggtaatgtagtaggatatgaacgtgttccgggtggtgggttgaaaccaataccgggaaaactgttctatcgcggttatgatgtagaagatatttctcacgctataatcaaagagaaacgctttggcttcgaagaagtggcttacctattgctttccgggcgtctgccggataaagaagaattgctttctttccgtgagttgattaacgacaatatgccgttggaacagaaaacgaaaatgaacatcatcgagttggaaggaaacaacatcatgaatattctttcacgcagcgtactcgaaatgtatcgttttgacgcaaatgcggatgatacctctcgggataacttgatgcgtcagagtattgaactgatttcaaagttccccactatcattgcttatgcttataatatgcttcgtcatgctactttcggacgttctctgcatatccgccatccgcaggaaaagctctctattgccgagaatttcctgtatatgctgaaaaaagactataccgaactggatgcacgcaccctcgatttgttattgattcttcaggcagagcacggtggtggtaataactccactttcaccgttcgcgtaacttcttctaccggaacagatacttattcggccatcgccgctggtatcggttcgctgaaaggcccgcttcacggaggtgccaatattcaggttgccgacatgttccagcacctgaaggaaaatatcaaagactggacaagtgtagatgagatagacacttactacacccgaatgttgaacaaagaagtgtataacaagaccggactgatctatggtatcggacatgccgtttataccatctccgaccctcgtgctcttctattgaaagaactggctcgcgaccttgcccgtgaaaaaggcagagaaagcgaatttgctttcctcgaactgctagaagaacgtgccatcgctactttcggacgggttaaaaacaacggaaagacagtgtccagcaatatcgacttctattcgggcttcgtgtatgaaatgatcggtttgccgcaggaaatcttcactccactgtttgccatggcacgtatcgtaggctggtgtgcacaccgcaatgaagaattgactttcgacggtaaacggattatccgcccggcttataaaaatgtacttgatgatttggcttatatcccaattaagaaacgctgataagaacaaatccttttattgaatagataagtaatcccggatgtgtgcccgatcatttcagaagcgcatccgggaaattttacattttctccttttttatgttcgtaaaagaatgtacttcagattctttctattttttgtatcgtcgtttatctcatttttgttatttttgcgtgttacaaaatagatcggtatgagtatagatacttttaatctgtttctgggggtgatgagcctgattgctttgtttgtttttatcgccctttactttgtgaaagccggatatggtattttccgcacagcatcgtggggcgtagctatctccaataaactagcctggatattgatggaagctccggtttttgtggtgatgtgtgtgatgtggatctattccgaacgtcggttcgagccggtgattttcactttcttcctcttctttcaaattcactattttcagcgtgctttcatcttccctttgctattgaaaggaaaaagtaagatgccgctggcaatcatgtcgatgggagttctttttaatttgctgaatggctatatgcaaggaaaatggattttctatcttgctcccgaaacgatgtatcaagccggttggttcacttcaccgtggtttattatcggtacactgctctttttcgcaggtatgctgttgaactggcagtcggattatatcatccgacatttgcgcaaaccgggagacacccggcattatctgcctcaaaaaggaatgtaccgttatgtcacttccgccaactatttcggtgagatactagaatgggcaggttgggcgatactcacttgttcactttccggtctggtcttcctttggtggacgattgctaaccttgttccccgtgccaacgctatttggtgccgttaccgcgaagaattcggagacgcagtgggagaacggaaacgagtgttccctttcctttattagggacgcttttcatcacgacttatgtatgacttaaataaaatatcaactactatggaatctaaactttttagcccggtcacctttggccctttgacgctgcggaatcgaacaatccgttcggcagcttttgagagcatgtgtccggagaatactcccacgcagatgttgctggattaccatcggtcggtagctgcggggggagtgggtatgacaacagtggcttatgctgccgtgacacaaagcggactttctttcgaccgtcagttgtggttgcgtccgtccattattccccgtttacatgaactgacaaaagccgtgcacgatgaaggtgccgcagtaggtatacaaatcgggcattgtggaaatatgtcccataaaaatatatgtggtgtcactcctatatccgcatcttcaggcttcaacctctattctcctacgtttgtgcgtggaatggaaaaagaggagctgccggaaatggcgaaagcgtatggaaatgcagtcaatctggcgaggaaagccggatttgacgccgttgaagtacatgcggggcacggctatttgattagtcaattcctgtctccctacaccaatcatcggaaagatgaatatggcggttcgctcgaaaatcggatgcgttttatggatatggtgatggaagaagtgatgaaagcggcgggcaatgatatggcagttttcgtaaaaatgaatatgcgcgacggcttcaaaggaggaatggagatagacgaatccatacaagtggccaaacgtctgttggaacttggcgctcatggattggtgttgagtggtggttttgtcagtaaagcgccgatgtatgtaatgagaggtgccatgccgattcgttcgatgtcttactatatgaattgttggtggctgaaatacggagtccgtatgtttggcaaatggatgatcccctctgtacccttcaaagaggcttatttccttgaagatgcactgaaattccgtgcggctcttccggatgcgccgttgatttatgtcggtggtcttgtttcccgtcagaaaatagatgaagtgctcgattccggttttgatgccgtgcagatggcgagagcgttactcaacgaaccgggattcgtgaaccggatgaaacaggagcaacaagcacgctgcaactgtggacacagtaattattgcataggacgtatgtatacgatagaaatggcttgtcatcaacatttgaaagaacaattaccttcctctttacaaaaggagattgataaactggagaaaaaatgagtgaaatgaaatgggcaatcatcaccggtgcggacggaggaatgggaacagaaataacacgtgccgtagccaaagccggttatcgaatcataatggcttgttatcatccgaagaaagcggaggttgttcgtgaacgtttgagcaaggaaactggaaacccggatttggaagttatggctattgacttatcttccatgcaatccgtagttgcttttgccagtcagatcttagaaaggaatcttcccatcgctttgttgatgaataatgccggaacaatggagacaggttttcatactactttcgaaggattcgaacgaacggtaagtgtgaactacatgggaccttatttgcttacccggaaattaattccgctgatggtgcgtggagcgcgtatcgtaaatatggtttcctgtacatacgcaatcggcaagctcgacttcccagatttctttcatagagggaaaacgggaacgttttggaggattcctgtttacagtaacacgaagctggctttactgttgtttactttcgagctttccgagcaacttcgagagaaggggattagcgtcaatgctgccgatccgggaattgtttctactgatatcatcactatgcacaagtggttcgatccgttgacggatatttttttccgtccttttatccgtaaacccaagaaaggggcttctacggcaatcggtttactgttggacgaaaaggaagccggtgcgacagggcaactgtatgtcaataaccaccggaaaaatctgtctgataaatacacgaatcatgtgcagaaagagcagttgtgggagataacggaacgtgcgttggcgagttggctgaagtagggtttcttttctttttttatttaaattatccagtatttacttatatataggtattgtacatatctatatacctcatttttgttgtcttatttttaccaatagatagggattgtttagcacttcttttttctgcttacctttgcatcgcttttagaacaatgaaaaggttataaagtaaaaaggagatgagcaataaatattttttggtttttctggcattcttgttttccgtatccgtatattcacaacaggggcgtcaccgtagtagtttaatttcgggcagagtgatgtccacagaaaaagaagtagtggattttgcgacagtttatctgaaaggaaccaaccaaggatgctatacagatgaaaaaggtatatatcatttgaaaacgacagcaggtgaatatacactcgtcgtttcggctatcggttatcaaacggtagaaaagaaagttaaattagctaagggagaaagaataaaagtaaacgtcactatcgcgccggcggtaaaagaactgggagaggtgctggtcacgacatccggagtcggccgtgtgaatcaatctgcttttaatgcggtagccattgatgcgaagaaattgcataatagtacgcagactttggcgggtgcactgactaaagtgcccggtgtaaaactccgcgaatcaggtggagtgggatcggatatgcaattgtatatcgatggctttagcgggaaacatgtgaaaatcttcattgacggcataccacaggaaggagccggtgctgcattcgatttgaacaatgttcctattaattttgccgaccgtatagaagtctataaaggagtagttcccgtaggattcggaaccgatgccattgggggagtggttaatattgtcaccaataagcaacccggaaagtggtttatggacgcttcctattcttacggatcatttaatactcataaatcatacgtgcgcttcggacaaacgttcaagaatggttttatgtatgaggtcaatgcttttcagaatttctcggataatgattattatgtagacacttatgtacgcgaatttgagattaaagaagatggaagcgtacgttttccgccacttgataaaaataagatttatcatctgaaacgttttaatgaccagtatcataatgaagccgtgattggaaaaatcggcctggtaggaaagaaatgggcagaccgtttggcgttgagtttcaattattcccatttctataaagagatacaaacaggcgtttatcaagatgttgtgttcggtgaaaaattccgcaaaggacattcgttggtcccttctttagaatattacaaaaagaacttattggtgaaaaacctggatctgctgttgactgccaattacaatcataatatcaccaacaatgtcgataccgcttcgcgggcttacaactggcgtggagatttttatgaaaaaggcagccggggagaacagtcttaccagaacagtgaatctaaaaataaaaactggaatgggacgctgaagatgaattaccatatcggacaggcgcatacgtttactttcagtcatgtaatcagtgattttgaacgtacgagccgctctaccatcggtgtttcttccaaattcacggacttttctattcctaaaatcacccgtaaaaacgtcagcgggctttcttaccgtctgatgccgtcggacagatggaatgtgtcggcatttgccaaatattaccggcaatacaacaagggaccggtatcgcagaatacggatggaataggcaactatatcaatctgtccaatacggcaagcgctcttggatatggagcggcaggtacctattttatatggaaagatcttcaggtgaaactttcgtacgaaaaggctttccgcctaccgaccacggacgaactctttggagatgaagaccttgaagctggcaaaatgaatctgaaaccggagaaaagtgataatgtcaatttgagtttcagctataatcatcagtttggcaagcatggattgtatgccgaggccggtttgatatatcgggatacgaaagattatataaaaagaggactggacgtattgggaggaacaagctacggatattatgagaaccacggtcacgtaaggaccaaagggtataatttgtcattgctttatagcttctcgcattggtttgatataggaggaacatttaatagcatcgatactcgtgattacgaaaagtttctggcgggttcctctttgcaagaaagcatgcactataaagtgcgtatgccgaatctgccctatcgttatgctaatatcaatgcaaatttttattggaatgacctgtttgtcaaaggaaatgtattgagcatcggctatgatagctactggcagcacgattttcctctttactgggagaatctcggagataaagattcaaagaatatggtgccggaacagttttctcataatctgtttttgtcctacaccatgaagaatggacgttataatgtatcatttgaatgtcggaatttcaccgatgcccaactgtttgacaattttagtctgcaaaaagcggggcgcgcattctatggaaagttcagagtgtttttcggtaaataataagagtcagtttttagtatcaatcaataataaagaatatatgaagaagtttttattacaggcttttgccgtagctttttgtttgggtagcggtgtgtttgtggcatcttgcgacgatgataataatccggtggataacccgccaattgatggagaaacagcttatgtggtggctgccacaactggtgaagcaagttatttggtagtagccaattctttggatgaaggaacagtgtcgactcaagggaatggaaccgaagtgattggcggtacctattgggtatataaaggactggattatgtgtttgctttagtttataataaaggtggcgcaggtacaggagcttcctattatctgggggcagatggtaaaatgaaagaaaagtacacatacacttataatcgtatcacgtcttatggaacctggggggataaagtggtgactgtttccaccggggactcgaaaataacagatgaggatcagaatgtggctcaagcattgttgttcaactatttggatgcgaccgatggcagtcaggaagagggtaccttgcttgccgaaaattacttgggtaatggtgaaaaagtttcatgggcaggtctggttgaagctaacaataagatttatacatctgtcatcccaatgggaatgagtaagtacggtattaaaaaatggccggaagctgtgacagatcaggaacttgtgactaagactgacggtggtagcggcagcggtgcatatacagccggtgtcattccttctacacaatacccggataatgcttacgtggcaatttatagtggcacgaacttcaatgagactccggtgattgccaagactgataaaataggctatgcatgcggtcgtatgcgttcacaatattatcagaccatttgggccgctgataatggtgacgtctatgtgttctctcccggatatggacgtacggcagtttcatcttcagatttgaagaaggtaacaggacagaaaccttcgggcgcaatgcgtatcaaagcaggcgcaacagatttcgatccggattactatgtgaactttgaagagataggcactaaacatcctattttccgttgctggcacatctctgaagattacttcctgcttcaattgtataaaaagggagcggaagatatgattaatggtggtacaagtgcagatgttagcgaattagctgttttcaaggcggaagatcagacgattatgcctgttacaggtctgccggctgacggaaagtttggtggcgagccttatggagaaaaagggtatgcttatatggctgtcactgtgactacgggcgagaaaccggccttctataaaatagacgcaaaaacaggcaaggcagtcaaaggtttaacggtagaggctgacgctatcactacgataggtaagatggaatatctttcaaaataatacagtcggttaaatagagaatcttttgtagataaaagcctgccgagcggaaagctttgcaggctttttcaagaaataggattgaaaacatgaaaaaaatattcagaaagatacatttgtggctttccgtccctttcggactgataataactcttgtctgcttctccggtgccatgctggtatttgaaaatgaggcgaatgagtggtttcgacgcgatctttactacgtggaaacggtaaaggagtctcctcttcctatggataagttgcttgaaaaagtggcgacgacattgcctgacagtgtatcggtgaccggtgtcagcatatcttctgatcccggacgtgcgtatcaggttagtctttccaaaccacgtcgtgcatctttgtatgtagaccagtatacgggcgaagtaaaaggaaaaagcgaacgtagcggcttttttatgtttatgttccgaatgcatcgctggcttctggatagtatgaatccgggaaatgaaggaatcttttggggcaaaatgattgtaggtgtcagtacgcttttacttgtttttgtactgatttcgggaattgtcatttggtggccgcgtacacgtaaagcattgaagaatagcctgaaaataacagcaacaaaaggttggagaaggttttggtatgacttgcatgtggcaggtggaatgtatgctctgatctttctactggctatggcactgacgggattgacctggtcttttccgtggtatcggacggctttctataaggtcttcggggtagaagtacagcaacgtgccgcccaaggacatgaacagaaaagtgatgctcaaaagagggataccaaactggcagcccatcgggaaaagaaaagagaaggaaatgaggttcgaaagggtgaaagaggcggacgtccggaaaacaatcacagtgatatgtactcggtaacttcacccttcgtttattggcaggagatttatgataaactaagacgtcagaatccggagtataagcaaatcagtatttcttctggtacggcaagcgtgtctttcaaccgtttcgggaatcagcgggcatctgaccgttattctttcaatacggataatggtgaatttacagaaacaagtctttatcaacatcaagacaagtcgggaaagattcgtggttggatttattctgtgcatgttggtaactggggaggaatgtttactcgcatacttacctttattgctgccttattgggggctgcactaccactgactggatattatttatggataaaaagactcataaaggtacggaaatgaatgaaattttttcctactataaagttgaaaaacataaaaacatctgccacctgcaacgaaactgtctttttcgtagggcgttgccctacgctatataattaagccctttcagggcactccgcaaaattatcatttacttgtcattttcacatactcaatgaccatcaaaataatttgagtcatttctttagcggagtgaaatgcaatgcggctccgccacttgcttttagcttcaaaacaagcttatctccggcttttatcttcttatgagtactgcgtactttcgtgcgtgtattcagcttgtcatcatcttcgtacaggtgaagcatgtacttcttacccggttccagaaaatccgtagtcaatgtaattgtgcgggcttccgtattcgtcattgctcctacaaaccagtcattccccgaacgacgtgcctgaacgatatattcaccaatctctccatctaacgcgcggctgtcatcccatacactcggaattgctttccaaaattccagttcttcttctccctggtagaattccggtctgtcataccaaaacataaattgcaaaggactgtaatacacagctgccatcgccaactgatgtgctttcgtattcttcacccgattattgaaatagcaaagcgtatagtctcctgcacctgccagatagcgggtgaaaggaagagtcgtattgtgtgtggcatccggcatttcttcatttccacgaataccttcctgcgtcatcaggttaggataagtacggctgaaacctgtcggacgatattcgtcatgaatatctaccatcagattatattctccacatttacgaactgcatcatgcaaccaggtactccaacgctgattacctatctgtacaaaaccgaacttgatacctttcaatccccattttttatacaaaggcaacagaatatccaactgctgcactaatgcgcgctgattgacatacaccataagtccgattcctttcgattcggcatatttacacaaagcaggtatatcaaggtctttatcagaagaaactgtagtagcgtccgaactcattttcatttccggtccgtaccagcctgcatccatgtgtacatactgaataccgcgttctgccgcaaaatcaatggccgcttttactctatcttgtttcaagtcgcccgaacggaatactttcccgggtttgatccaagaagtatcagccagtttgcaagccggattcagattcaagacaagatcattattattaattaaatcgaccggacgttcgccaaccatgattacacgccacggagtactgtaaggagaaataatatcgacgctactatacaggcttgtctccaaagtggaaggtttctctgccgataaacggaatttaccacgaacataatccaccatttccgcttccaacaaggctacagataatccatcaggcagtttcaatgtcaaaggacgctcactctcctctttgccccatccttccaacggacggagttcataaggcccttgtgcccaacgttcataatacgccatcgttccttcaggcattgtgaagctagtctgctcaccgacgatatgcaagaaaagcccgtttgtcatttccggaaaatgatagcggaaagtaactccttcattataggcgcggactatgatattcataaagtagtttttacgcttatcataaccaccatcccgattaccttttccttctcctttcttgaacttcaaggtcatctcattatagcaatcacgaacctccgcacgctcgccatatacaggcttccatctctcgtccgtcttttgatgttcagtccccgtcaacttcagattctcacaccaaaaatgacaagtatcattcggtatacccaacgccgattcaaacaactgattttcaatcagaacacccagtttactttcttcaatcaccggacgatttttataagtcaaggtataatacatttgtgcattatcctctcctaccgcacgttgataaaaggtaaaacgataagctccatcaggagacgtcagttcctgacgggtttctgtcatcacatcttgcgcttttatcaatgccggtatcaccaacaacaaaagcaaaattcttttcttcattctatttacgttcatgtttattcatctttcctattatatacgaacgagaaagaaattatactcaaatatttattgcctgaaaagcttattccatctgttccctataaaaagtaggtgtcattcctgtcacccttttaaaaatgcggttaaaatgtacaggtgattcaaatccgcaagtagcactgatttgagatatattcatcatactactattcaatagtttacaagcatatccgatacgcatatcaagtacatactctttgaatgtttttcctgtgttttctttaaagtatcggcagaaagcagtagggttcatcgctgtataagaagcaatttcatccagaccgatagactcggtataatgtttattcaaataggcaatcactttttccattctttcattacgcataatcgaaggagacggagtataatgagaagtagtcagatacttcctgtgattactggtagccatcatttgtaggagtgaaagcaacaggataatttgatctactcctttggcagaaggtatttgttttaatagcttaatgattttccccgaacgggtaattgtgaatttaattcctctgcaagcatcctccaataaattcctgataggaataaactgggagtattgagatatagaataatgcatgaagtctttttcaaactgaatattgactcctcttactttcagttcggatttttcttcgttatcagattcttccccgccgtccggtggactttgcatactatgaggcagttcggaaccgaaaagaatcaaatcaccttttgaataggagataatgctgtcacccaccagacaatccccctctcccttctccacataaataatttcatactcactatgaaaatgccacggatacgtgaaacgtggatattcataaaagcgggcacggacgggattagaagtcgtaatagtcaacttctcattcattatcttcttcataaatctcctttctaaactgcttttgcaaagataggtaaatatcttgcaaaaatacgcatcatagcatgtataaaaacccgctatttttgcatccattcataaaaacatttgatagaaaacatgaacgaattatttagtattgccggtaaagttgctgttattaccggagcaggtggtgtactgggcggaaatattgcccaacactttgtacagcagggagcaaaagttgtagctattgacattcgtcaggagcaactggacaaccgtgtggctgaacttaagcaatacggtaacgatgtaatcggcatcatcggtaatgtacttgacatcgccagcctggagaaagtagccgaagaagtcgtagccaaatggggacagatcgatattctattgaacattgccggtggcaatatgccgggagctactcttgaaccggaacaacatttttatgacatggatatttcctgttgggagaaagtgactaatctgaatatgaacggaacggtttatccgtctatgatattcggtaaagtaatggcaaaacaaggcaaaggatgtatcattaatgtatcctcaatggcagcatacagcgctatcacccgcgtaccgggatattcggctgcaaaaactgccgtagccaatttcactcaatggctggcaagcgaaatggcacttaaatacggtgatggtatccgtgtaaacgctattgcaccgggcttcttcatcggcgaccaaaaccgtcgtgtactcatcaacccagatggttcattgacagatagaagcaagaaagtattggctaaaactccaatgaaacgtttcggtgacatcaaagagttgaatggtgcagtgcatttcctgtgtagtgaagccgctagcttcgtaaccggagcaatgttacctattgatggtggtttcagtgcattcagcggagtttaagcaataaataatagcctgttataaagagaaagactatgatggaaaagacttggagatggttcggcaaaaaggataagataaccttgccgatgctccgacaaataggggtaaaagggattgtcactgccctgcatgatgtaccgaacggtgaaatatggacaatggaagctattaacgatttgaaatcatatatcgaatcttatggtttacgttggtcggtagtggaaagtcttcctgtatgtgaagcaatcaaatacgcaggagcggaacgtgaacagttgattgagaactacaaagtaagccttgccaatttgggtaaatgcggcataaagacagtgtgttataatttcatgcccgttatcgactggatacgtacagacttgcaacatccctggccggacggaaccagttcactttattacgaccgtattcgctttgcttatttcgatatccgaatcttggaacgtgaaggagctgaaaaagattacactgaagaagaacttcagaaagttgccgagttggataaggttatcacagaagcagaaaaagacgctttgattgatacgatcattgtcaaaactcaaggttttgttaatggcaatatcaaagaaggagataaaaatccggtttccatcttcaagcggttacttgctttgtacaaagatataaaccgggatgctttgcgtgaaaatatgcgttatttcttatctgcaatcatgcctgtatgcgaagaatatggagttaatatgtgcgtacatccggatgaccctccattccaggtattaggtttaccacgtatcgttaccaatgaaaatgatattgaatggttcctgaatgccgtagataatcctcataatggattgactttctgtgcaggctctttgagtgcaggcgaacataacgatacacgtgagttggctaagaaatttgcaaaaagaactcatttcgtacatctgcgcagcacagctgccatgcaaggtggaaacttcattgaaagctcccatcttacgggaagaggacatctggttgaccttatccgtatcttcgaaaatgagaatccgggattaccgatgcgtgtagaccacggacgaatgatgctgggagatgaagataaaggctacaacccaggatattctttccacggacgtatgctggctcttgcacaagtagaaggaatgatggctgtggtggatgatgagaaaaaacgacagataatattataatcatcacaatgctgatatagtcagagcttcgtcagagcaataacctcattatttgtttcaaggcgggaaacattttgtttcaagcgttgaaactgatggtttcccgtcttgaaactttagttccaaaggctcgaaactccagttccaaaggcgggaaactatagtttctaaagcaggtaaattctatctcaaagacaagaaacaaccattctgtctctaggcttttagttataatcatataattccgatacaataaatacaacggactgttctctcaatagctaaacctttcaatgccaatgcatacttatatcatttggtaagcgtcgacagtgtgagagtaagttttaccctcacactaccctcacctttaccctcacccacgaaagtacgatggataaagggattgagagccgggtgagagtgtgagggtaaaatcaacacaatcttttatttgttagctactttatctgtatcttccctacaaaatcttttttatctatattcagttcttccaaagaggcgatccgtttgccgttcaacattatgttctcaaacaaaatattctcaaccttcctattcttatcataaccttccatcaaagaaggattgatatattttccggtacatgaaatattacggaacgttatgtttctgacacctctgccgggacctgtgttatacttttggttatacatcacccgaagatgaaacaactgtccttcctggatatgttccacacgaatatcctcaaaagtgatgttttgtgccagattgtgatctcctacattaatagtcatgcagccttggtaatcacgatcgtcctcatcatgttccaagatatcgatattcttgaacaatatatcttctaaaacctcatctcctgttttcgtatttccatgcgtaccgatattgatagggtgagcaatatccgcccatagtgtagaattaagtacacggatattacgagaatctccataataattccaacgatgcgtatagatggctatacagtcgtctgaattacgaagaaaaacatcatcaatcactacatccgagcaagacataaaatccaatccatcactccaaccctgataactgaatgatttcaaattcttgatagtaattccctgtgattgtccaccggaaactgtatagtgacgggagttgacaactgtaattccatcaatcagtacattcttggagtatgccaccgatattccctgctgcggttcaagcaacataccgtgtccgagaatctttacattctctacactgtcgcaagtcaggcaacctttcagcaccgctccaccttccagatagacagtcgtgttggaaggaatacggaagcatttgcctgccacatctgtgggttcgtgtataccggactcaaaatacatcacattcggatcattcttatcaggcacattctcaatgatcggattggcaaacacatgcagattattcaaacggtcaccgttgaactctacagagagtttttgtggtttatccaatgtgaacagcagaaaatttccgtctatctccggctgaattcctttagatagtggacgcactactgctgaacggagttccccgttattcttttgcaccagcacttccactttaccggaaaaatcaaactgtaccatggttgcatccgacttggtatccatatccacctttacattatattcataaaggtctacccaatctttttcacccacttgccgtacttttactgtataatcgtcattatggcgggcatagtagatgccttgtggcaccggatagatgacaatttctgcctgtataactcctgaagtcattacaagtaaaaatgtaagcgctattcgtatcaatctattcattttgaattattcatttattgtgcatacatcaatgtaccgagtccaagtacatcatacccaccagagttagcatcataataaccgccgccgccttctattcctacatattcggtagcaatcttagtatatttgagattatcatccgagatgttttttatccctttgtaatgatagtaaggcaacgcccatatcgcacgtttgatccatttaccgccaccaagtgttgtttgttcttccggaatcggatatccccattgactctgtttttgccatatataagtagtatatggtacagtctcattggtataattacagcaagcggcatattcgcaggcccgtaggaagagattatcatcataagcaaagaaatcgtctccctggctccatgccaactgacaaataattcccatcaatccgacacacatcaacgtgtgtccttggtcacgtccactttcctgccattgagcaaagttatagtccggtgcataatcgtgatagatagcacgacgtaaacgtccgtttgtatcacctgtctgcaaatgggcgataccttcattataaatatcacgacgatcggttacaatgccgatagccattttagccgctatattacaaagacaccagttagcccaataatgtaacgcattcgtatcgtgatgacgtttcagaaaatcatcattagcaggatagaacactttaagcaaccaattctggaacgctgcgaagtccgcacgatcccatcctccataatccctcaataattcaccggcaatagcaaattcataaccataaagtcctgcagcaagcgataaattcgtattacctgttacacctacacaagtctgtacccacttattcagattctccaccgcttttgccgcatattcatcatcttgttcaattttccaacgaagcgcttgctgatatacaatagtggctcctctggctgcattcatgtaattttcatctcctgaaatacctcgtttaatccattctgtaggataagtatctgccgtcttctgcgaaaactggctttctactaataattgataagcacttacccaaggctcttctccggcagcttttttatcccggatacgctggaagtcttcctctgtatgcaacccttcatgcagcataggttccgttgacggtttaagttcaacctgttccaaatttacgttattatcaggaagaggaattttattcaaatcagtttccacattgacacccggaaggtcaatgccgtccccacatcctaccaaaaacagggtagcaaatactgcggttatataatatatctttttcatcatatttttggtttaatggtacaccgcatctaccattgattacggtgcacccaattatagtttattgctctactaactctaatttgaaattatctatcttagcccgtccttgttttactgtaatcgtacatacaaaaccaatgacaacatcggtaggctcttcaacaagaatatcaactactacatcacccgtacccgaaatagaagcgtttgccagactcttacttggtatatcactcgtatttgccatctcgttacctttacaaaccgcaacataaccggtaaaacctctgccgtcatattcataaacgtgtgccgtcaacttatattttcctttttgaagatgagaagtctgatataccttaccatcatttttaggattgtcaaatccccaatctgtttgtaaagccaaacctgcatcacttccatcaccatatttcgttttaaatgccaaatcaacagcagcacctccttcaccagcagtcaagttagagttctgaactatccaataagcagcttttgcccactctccttttttatggaatcctttatccccaccttcttttacatattcaaaaggctgtttatagttcatgagtacatattgagaaatatctccatccaccggcagaggttgtaacatatcactctctacgggttgtgcaataccttcaaacaccattgttacttttccaccattgaaaccttgcggaaccgttacagtaatagaagtcgtagtaatctctttaaccgtaacgggtacggatattccctcaaaagtaactgtaacagaattcttatccgttccaaaaccttttcctgtaaatgttatttcctgtccggcttttactaatgtgccattaggataaatatacggtgtttcaacagaagtgatttccggagtttcccaaacctcaaatgtgcccgattcgcccatctctatttccttaccctgaattatcagtttaatcttcaccggagcttcagatgaaactcctttgggaacattcactacgatattacctttatcattcagtgtcactttatcacaaattgtttctccgaaaaagacctgaatattttcagctttcgtaccaaagttctgaccaatgatcgttacttccgcattaatgtatccggctttcgttgaaatgcctgttactgtcggcatcggtaataccgtatatttcaactgtgtcccgatagcttcaaacggagtaatgacagttattgtataatctccggcttccaacgaagcaggtacagtgagtggaatactcttatccgtcaaattatctgtatctattgcagcttctacaggttctccgccagctttaaagaaagttactttcaaaggctccaacccttcaacagacttatccagcaattcttgcacaagattggttcctgttattgcaaatttactgccagcaaaacctgatggaaccggttcgtcttccttaggagtatcaagcgttgcatgcttcaacacagtgaaaggataagaagccaaatcaatcgtttgttctgccataataagtgtcataactccactgacagctgtctcgggaattttggccataaattcggtatcaataggtgtacccacaatctctgccttgtctgtggaagtcccgaaagtcaaagtatacagtgttttagaagaaacaaattcttgtccttcgaaaacgatactggcacccggaaaaccataagaaggtttcactacgctgacacccggcttaccaagtacacgataaactagatcagtctccacacgttgcccgaaaacctcaacggttatctttccgtttgttgccgattccggcactttcgcaaggatagcatcatcggcgcaggagactactactgcctcctgggaaccgataaatactttcacatcttctgttatgataccaaaatcactgccacttacggtaaactcattcccaacatatccttctacgggatctatctttgttacagtcgccacaggatcagtgtaactcattgaaacaatttcttcgttatcctcgtcacaagcagctaatgcgaaaagcgaaagaaaaacgggaaacagatagttatatattttcttcataatcttaattatattatcacgatgaattactcttttttctttttccacatcattcaagaatcaatttcaattctgtcaccttaaagtatgaattacctttagccagagaagtcaggaatccaatgacaacatccgttgtctccgtcacttcaaatgaaggggttaccaaaacacccgagtcatcatttgttccagctttgtcatagatcgcacaaactccatttaattgctcaatatcagctacattcggtatatcactctcactatttcctttggccatcaatgcagaaataaaattccccgcatcacttactaccatcgtataggcataagtaacttccagtctgtatttaccaggacgaagtgtagcaacttgccatatttttccattcgtataagcttccttctcccatccattctggaacgctaatgtgaagccctctgctgctttatactgcattccggtaacagtagtattgttttttgcattgaaagatgccttattctgattccatactgccggagtccaccattcaccattcttccaattttcatcatttgccttggcaaacggctgcttgtagttttgaaggtaaagcactgttacatcaccctttgagttaggattaaacattgcactacctgtcattgtatatccatgaatagttacagtcacattacctgtcttataatctgcaggagttgtcgcaacaatagtagactcatccaccagttcaaattcagccggtgttccattgaagctgacagaaatatcagatggatccgtaccaaagttctcacctgttatagtgaccttgtctcccgtatcggctaccccttcaccgtcttcactatcagaagtcactgtaatgacacgcggtgtaggcagtactgtataatgaccgatattctccacctttttattataaatctgtaaagacagattgcctgttactgcagtttccggcacttccactaccaaacggttatttttgcaatcgagcactttattggattgggcttcaccgaagaaaactttcactgcttcagcacggtcaccaaaatcggttcccgtaataactacctgtgtagtgacatatccgtccgtaggataaatgctctccactactggcacgggataatcataaactctatacttggggtcttgctcacaaccggagaaaagtgcggaaacacaagcaagtattgccaagtgaaatgtatatttgaataaaaacttcatataatctatggtattatacgttaaacgattgaatgattaatatcccggattttgtaccagatttgaattcaggttgatttgatttcttggaatcgcccacaaataatctcccttagtaaatgcacagtcggatgatttgaggagcactacacaaggtaatttgcctttacctgtttccacttcttccgtccccttcgtaaagatagccgaattgaaagcactggtagcgttcccgttttcgtctacaaatgctgtcggatagctggcattacctactaccgcaccgcaacgagactcattcagattcttctccgcaatgccccaacgtttcaggtcgtcacaacggaaaccttccatatagagttccaaagcacgttcacgacggatctcatccaacattacctgattgactgtcttagtcgcatttgccggcactccttcctgaattcgctttgccaatgcatttgttaggttagcaattcccgcacgggcacggattttatttatcgacttattcaactggtcatctgatatttcaccatagcgttccatcacggcttcggcatagttcaggtatacttctgctaaccgaagtaccggataattagccgattcatctttactttgacgttgaatatcagtaatagcaaacttagaaacaccatacccacagctctcaactgtcaggctcgttgaatatgaacccacataagaagtcaaacggaaatcccggttctgaaattcatcccccggattcttatacccctgaaacttatcggacatgctaaccggaagcccgtcagtgcataaaaacatatcaatcaatttccggctgggacgcatatccgtataaatcacctgattcaaatcaacctgtcctttacgcgtttcctgactatatacagaagctatgataaattccttgttcgtcgctcttcctgcaccggcaggattgctagcttcttcttcaatattaaacagataacggctactcaaatttttcattgctgctacattattataattccaaagagaataagcagcatcccccatcactatttcggatagttgaacagattcttccaagaaagtatttacctgatcggaagccggaccggcagaaccttcaaaatcagtagaagtgccattgtacttacgccaggtagcttcataaagtaacacgcgagccttaaatgcctgtgcagcctgtttgctgattttacctttgtcggcagaggttatattctgttccaacggcaaccctgcaatagcctcatccaaatcggaaagaatcaagttgacaacctcataacggctgttacgttttccatataactccggtgaagtcacgtcgagaactttcgtaacgacaggcactccaccaaaaaacttcaataagtaaaaatagttataggcacggaaaaaatgaccttcggctaattcttttttaatatccgctaaattacctgtataggaagaaactgctctttcaaacatgtgattagtggcacgaatattaccatagcaattaccccaacggctatcgtcattaggaactcccatcacaccggtccccacaccatacgaatatctgaaacaagtagaaagatcggatgccgcatccatgtgatcgaatatacttccataggaagactgccatcccaataattgcccgtaaagcccgttagcatattcacggaaatgctccggagttttgaaataaatcacatctgtcttggcatccagtggttccaagtcaaggaacgtattcacgcatgaagaaaatcccaatgcgcaggtgcaaattaatatatagttcgttatctttttcatatcttctattctgtatttaattttccatagctactataaagtgatgttcagaccgaacgaccaagtacgtgcaaacgggtatccactgttgttggaggctgctcccatttccgggtcgaaaccgtctcgaatactggtagcttcccataaatcattaccagagaagtaaacacgtactttttccagtttcaccttgcgagtccatatctgcggcaatgtgtagccgactattaatgttttcaaacggatatagcggttattctgcatcataaagtcgttattctgataattccagcgtgcgagattcgcattggtagtcaagcgagggaattcagcattcggattgctctctgtccatgtctttcccaaatatgtcgggttctgattggcagtacgtgtttgaaaaggataagccatccagtcattacggataacatactgcttgccgacaccttggaacattgcgttcacatcaatacctttccatgatcctcccagtgtgaaaccgaaaacaaaatgtggattggagtcaccgagatattgcaaatcgctattctcattccctgcaccggaaatcttataatcaccattcaaatccaaacgtttggtatcacctggacgcaaccggcttgcacttcctgctcctacaccagtcaaatcttctttaccctctccatagagtgcataatagcggtctacttctgcctgatctttaaagtaaccatctgtgcgataaagaaagtacgaattcaacggatacccattcacggctgcattccaaccagccccataagaatctgctccttccatctctttcaacagactctttgtatcaccaatattaaagttggcatagtaagaaaagtctttaatctgatcgcgccatccaatagtgaattcccaaccttttacattcaaatgaccactattcgttttaggagctttacctcctaatacacccggatatgtgacatttaccaacataccggtattatcttttataaaataatcgaatgtagctttcaaacgattatcgaaaaagttaagatcgataccaaagtttttctgtgaaactttctcccaagtacggtcataagaaattaaaccgccaaaacctgaagatacctgattggcaggtatagttccaaaaccggctgttccaagagagacagtagacacataatcgtaatcacccagcccgacatcattacccgaactaccgtaacttaaacgcaacttaccaaaagaaagaacaggttttaaaaattctacaaattgttcttccgagaatgcccatcccaaagagacagaaccaaagcttttgaaacgataaccgggagcaaacttggaatttccgtcacgacgccccatcaattcaaccatatatttttccgcatagttataattcaaacgggcaatatatgaataggtaccattatgagtctttcctccaccgttaccctgtgtacccgtagccaaattcaaatcgtaaattccggcatcctcaaacttctcacgggcggtaacaactttcttagtcacccatttctcggcattgatgccgaacatagcatctatattatgtacttcggcaaatgtacgcttatatttcaataaccctgaatagtactgataccgggcattatttgcctgtaccaaatatcccggctgatgggaatctttaaaattcagcacatcttgcggagtactaagggtttgtgttgtttcatatactaacttcgccgtctgctcgccgaaccaattgtaacactgtaccggaagcgaatagcgttctctgcgatattcctcattttgaaatgaagcagtaccctcgaaagtgattcctttccaaatatccaccaatgctttaaaatcgacacgagtagtcaacttctctctctcgtcacgtccaccatccgttgtagctgctgccgcattgcgatcacctacattaccgaagttagcgtaccattgtccatagggattttttgccgggaaaaacggagcatcgtttccgtaaagtgtacggtcgataccatgtgtgggtgtttcggtatttgttttaatcatactggctaaagtctccagtttgaaccaatcagtcaatttgatgccgtagtttaagcgcaagttcaactgtttctgtccgtcataggctgtagccagattagcctggttatcagcataagctaatgaaatgcggtaatcggatttatccgtagaacctgctacactcaagttatgctggtaagaataacggcgggcaaacaattcatccaggcgattggcattaccaacgaacatcgtaccccaatcggctacagtcgactcataaataccttcaatgccttgagccatcttcttcaggttttcttctccccagccccaccagtcatgttccggcatttctttattggcttccagccacatggaagcatattcctgcatactgggagagaaagccataataccattggtagtgaaacgcatattgaagccataatcaaccgttgtcttgcctttaccttttttggtagtaaccaagataacgccattagctgctttcgccccataaatggaagctgaaccgtctttcaatacactaatattctcaatatcatccgagtttagattttggaatgactctgaattcaatacgggtactccatccacaataatcaacggactaccgccattgacagatgtcagaccacgaatctggaaattcaaaccttcattacccggacgtgaggaagaacgagtgactaccaaacccggagtggctccttgcagagcagcaccgacattggtaatggcacgactttccaatacctggctaccaatttgttctaccgcccctgtcaacgtcgcttttttctgcgtgccataacccactacaacaacctcgtccagtgcattattatcttcctttaataccactttaaaatcagagcggccatgaaggttaataatctgatctacatatccgatatagctaacttttatctgtttggcatcagcaggaatattcagcgtaaaccgaccgtcaatatcggtaattactcctgcattacttcctacgaccactacattacaaccaattagtggttcaccattcgcatctgtcacaagtcctttgatgatgcggcccgtctggactaccatcaaactctcttctacagaatcatttgcatagagcaatacaccgggcgaaccacccagcagcatggcgaaagccaatgcgactccttttgaacataagaatttggatttaatttccataatactattaaattgttaaagttaatatgtgtttttccgaatctggtatttaaccgactttggagaattcatttttcaaataagtacgaaccgttttacgagccagtaataattgacattctactgtacggggagataaggacagctttcctgcaatggcaggacaagagagttcatgattgaaactaagttcataaatctgacggcgtttaacaggaagagcttccataacctggtcatgcatcttctttagttcacgaaaatgaatggtatcttctgtggtattccgactggtgtcttccatcctattatatatgtaggcgacgaaatcttcctgtttataataacgacggattttatcggttactatattgcgagcgatggtaaaaagcaaagaccagactgtatctttgttcacgaatgccctgtgttcccataagcggacaaagacatcctgtgccaaatcttccgcttcatgcggatggcaaatgcggatagcgatatagttcttgatatactccttatatttaagatagcattcagagaagaagtcgtcaaatgtagcttgctgtttattcatggcattaaatttatccgtttaacgatgatacaaaagtaggaacaagtttcaaattcaaataccacaaaagtaacagataacaaaactatcgtaacaagcgtgtatttttgcaaaaacttcccatttcatcgggataaatctaaccgtcacaccaataaaaaaggggatgtcgttacatttgacgactcccctgttcttatatttgcatggatgaaagctttcatccggaaggattcattatttattttcctgtgatgcctggaaatccggtatacgttttacgttcgcacctttcatcacacctcttttgatcgcttcattcgtatcggtgatttctttcttcacacgtttatagtattcttttgtcagtcctttctctactgcttccgattctgttactgcccaaagatactgataatccatcaacatcaaatccggtgccactattttaaagaaaacactatcatttgcaaatttttcacgtaagtctcccaaatagatggtatctgcaggatttacctccttaacatttgcattattttttgaactgctacctccgcaagaggataacatcaaacctcctaccaacaaaattaaaactaatactttcatatcaatatatattataaaataaaacttcttctgccccaatgtgaacaagatcttacaattatctcacttattcagcgcaaatgtaataattaaactacaaacacaagcacaatgtcattcttttcttcccgattcctcggcatattgcttgggaagcataccgaacatttctctaaaacacttcgagaaatagctgggtgaactgaatcctacccggttcgctatttcaacaatcggcaactgacttccttgtaataattgtgccgcccgtttcaaacggatgctgcgaataaagtctgtcggtgtatgtccggtgatggattgtagcttacggtaaaggctcatacgcaccatacccaaatcgccactcaattcttctacgccatattccggattgtccatgttcttttctatgtattccagacacttctgtatgagctgttcgtctactgaagtaatggtgatagcactcggatttacttctatgtttttacggaattcctgttttctcttttcctgctgctctatcagcttttcaatgcgtaccatcagcatatcaaagttgaaaggtttcgacatataagagtctgctcctacttcatagctgttaatcttgatatcatcggcagtacgggctgtcaataatatcacaggtatatgggaagtctgcacgttcgtcttgatccgacggcaaagttcgataccgtctactttcggcatcataatatcgctgataatcaggttcggattttcctctatcgcttttcgctctccttcctcgccgtctgccgcttcaatgatttgataaaaatcttctaactgttctttcaggaaagtacggaattcctgattgtcctccactaacaacagtttcttcaggttatcatcgactgtagatgtagtggtttctttctctttaatgtctggtgtttccgttccgatgatttcttccggcagttcgttcggttccggtttcaggtccatcggcaaccaaacggtgaatactgatccacgatctatctgactgtccactttaatacggccaccatgtatatttacatattcccttaccaaatgaagtccgatgccactgcctattttttcgtccccttcatttcctacctgatagaaacggtcaaagatataaggaaggtctgattcggatattccgattccagtatcagatacggatattctcacgtagtttctttcttctatctcttctgtcgcgagctgtaagttcactgtgcctccctgcggtgtatatttgaaggcgttggacaagagattattcataatcttatgtaccttatcccggtcgaagaacatataaagcgctctatgttcagattggttcacaaagttaaggtgcttctctactgccattggcatgaagttgttataggcagaaacaataaattcctccatatcgccgttcatcagatgcaacctctctcctttcatttccagtttgcggaaatcgagtagctgattcaccaatgacaataggttttgagcattcttatagatggtattcagttgctttttcatcgcatcgtctgtcaatcgacgtatcaccatgtctaatggcgtgataatcaatgtcagcggagtgcggagttcatggcttatatttgtgaagaagcggaatttcatctgatccagttcttctttctgcttcaacgcttcctcttcttgcatacgaatcatcttctgccggttgcggcggtttattacgtagatcagcccgaagattaagagaataactaaaattgcatagaaaatacgagcggccagtgtatcccagaatgggggatgaattacaattttgaatgcagactccggtccccatatccggtcgtttccggcagcggacacacggaagatgtattcgcccgaagggagattattatagaccacacgtccttgtccattctcaaaaagggtttccgtccattctttgtcaaatccttccagttggtaacggaaagaggtttgagaaggattagggaagttcagaccagaaaactcaagtgtgatatagttctcatcatattttaattgtacttcgtccgaataacttaatgctttatcaaataagacacgtccgttatatatttcgcccgaaacaaccggaacattaaacaagcggaatgaggtaaacagaggacgattgaggcactgattatctatcatgttttctggtgagaaagcaataaagccgttcatcagccccaggaaaagctgattgtccctggtcattaacgaagggaaactatataaatcatcctgacggatttcatcttccgacagacagctgattacatgaaagctgtatttatctgctcttctgtctacttttatcttataaatagaagtgactgtcgaaatccatatatcatggttcttatcttccactacgttcaggatagctttagacagaccttcttctttccctaatgtgtagctttgcccattgtaagtcaaaacgctcaagccatattgtgtagcaaaccataaagttccctcatggtctttgagtatctgattatacttgatacttccctgattgaaaatagaattagcctggccgtcttcctccggtatccatattttattcgttgcaggatcgtaaatgtagagtccgttatcactgcctacgaccaaccgggattgattatctatggccaatgcattcgctactttatattttttgagttcgggaaactgttcggacaataagtttatttgcccgttttcaggattgaataatcctacaccaccatatatacttacccacaatcgaccggaagaatcttcgaccatgacacggatattactgaaatccaattcattctgataatccgtatcgggataatcgtaagattgtacctttccatgatctatgcagtagagcccatcgtggtatgttccgacccaaacacgcttcttgctgtcctcataaagtacacggcaattcttctgactgaattcatgatagaatctgttcatgcttttagtctccggttcatagcgatagacaccctgagtagtacccatcagaatttctcctttagatgtttcgagcatacagcggatttcctctcctttccagtcgccatttatcatcttcttattgtacagcactattttattcatgctgggatgataataacacattccctgattataaagtcctatccaaacggaattattttcccggtcgcaatagatgctttgaataccgtttcgtactgtattacctgataataaaggaatatccagtgtccgggttacagagaaattgtgcatatcaatgacatagaatccatcgataacggttcctacccatgcatttccacctttatccacatccatagaagtaaaccatgaatagtgtccgagttggatacctgaaatttggttccattttttattatagacatcataatagcctactccacgatcccacatcaaccaaaagtcaccattatcgagtatcttcaaaaccacacggtcatccggtttcagttggtctttcaggaaatcaagttgatgcacgaaacgtttcttttctaaatcgtagcaacggatagcccctttctgatgaaccatccaactgtattttccatgactttctactccgagtaatcctccatagtattccataaactcatcattcctacaaacctgttcgattgattttgtctctgcatcgtacatatagacagaggaacccggcgtcagaaaccaacaatgtttctctgaatcaataatcaggtccgccactttatcctttaagccgaattgttgaaataaagaatctacgttatagatgtactgttcggtagtcaaatcgaagacgcgtaggctcttgcgttctttcatccacaaacgtttgtcggcatcaatatattgttcgggaataatatggttatatgctatcgaatattcgccatgaatattgaaagggaaatttgaatagttcgcaccatcatacaggcttaataacacagtacttcgcacaccgatacgtccgtcgggaatggggaaaacgctttttacatagttatccggtaatccttcgacaactccaatctggcggaatacataaggggattcttgcgagctaatataacccggatacaataatcccattagtatgattaacaaacatattcgaattttcatggccatctttttttgtagtactattattaagtacgaacgaagaatcaaatccccttatcctactttactattattttctgaatttcgagtttatctccggcttgctctatctgtaaacgaagtacacaagctcctgcgggaagagtgagttttcctatttctctttccgtccattgtatagaactgggtaattgcatgggttctgtctttacttctgaatcagaagctacggacaataaagaatttccttttgattgataaacaagataaacggtataatctccatcggtaggaatacttacagtataattcatccattctccatcttctatttgggtaacgacgtaattatcttcttcttttcgtagctctactgctccgtcaggtctgtattcgttgccacgtttctttcctacattgtgataggtatgcccttcgggatcttccgcaagacaataataatcgtaatcggcagccgatatttcactaggtagcaaatgaattcctgatacacgctttcccgtagagaaagaaacgggatcgcctgccatccagggagtcaatcgcttggtcaatgttccccagtcagtccattcataaaaccagttgggtgctatcccccagttttcgcaaccgtgatgttctatcatataatcacggtaacgtttcaaccaggtatagttgttctccggcaatccagcacgtactgcataatgcgccaatgccatttcacgagttccgccactacctgctacgtctccacgtccgtgaggagatacggctacggattcccaacgtccactacggctttttatctggagaaattttccgttctcaaaggtaacttcatttgaattcttactataacttgtcggttcccaaggctctttttgctcttcataggtctggactttagagaggttataacgatagttccattccaaaccaagaagcaaacggttattgagacaattatacaaagaatctccctgattccatgccatttctgcgatagctacataattgtggatacctgccaatacatgtccctggtcgcgactcgactcctgacattgaccgtttggatagatataatactgtagctgttcatcgtatccataatctgaaatcttgttttctcttccttccaatttataatcaagcatggttggtgatttcttaatcggttctttgctagtgaccgtcggtcctgaaggataaggtaaatcatccggtcgatgcttcattcccaataaataacggtaagcacggtcatacattacttcgttatctaagtaaatccccattgccatcattccacgagcagcgaaaagtccttgattaccaaaccttgcggcatcgaaattaaaaatattccaatagaatgtaactccgttctttgaatcatcccagtaatttgcatatttggaagagaaatcttccgtattgctatatccaggatagaccaacatatttttaaaacgttgctggccttctactttccaaccggaataatcacgcattaattcggcggcatcaattaaaaggtaaatctttccgttatctaatggtcctgttccacgactacttgtattggtataataagaattagcattcagatattcgaccgctttacgggcataagcctcatcgcccgtcagatgccaaagcaatgctaagtcatgtgcccgcctgccatctactccgatagtagcattaaaacgtccttctctgatttgttttccccgattgataacttgcgtattgagtgaagaatagggagattcctttaatttcagaaaagtagaataataaggctcatgtttcgccttgaccatagctttcatccggtctaaatcaccttgggtataggtgattccgggatggataaagttacgtcgttgcgcttgcactccattttgaatattcccaatccatacaatcccaataatccatataattttgttaatcatagtgcgattcgttttttatacaagtgataagcaaagatagtatttagtaataaaaaggagttcaaagtgaatgaaacatttactttgattagcataaacccgggaataaaactcttgtatttatactcatggttctcttccagactccttaattctgattccagtgcagctttgctctcatctattaatagataagttattatcttcctattgcaaagttctttccttctaatactaaagttactcttatctaatagaaatctataattgcaagctttgattataaaaacgaaagtttcatttatataattgcaagttctaattatataaatgaaacttgcatttatagtttatgtttaacctaaagaaagtttgatattagaagaaaagaagtttgcacctaatacaaagagatttttccattcatacttcatataccagattatgctatttgactgtgatattctttatgtattcattcgtgataaaatcatctatatttttcatcttcatgccgttgataatcacattatcgaagatgatattcttgacggaacgttctttatcaaaccctttcaatagagatggattctcccctactccattataaatgatattccgaaaaataatatcttcaattccccggccgggttgcttatcatactttgaattgaaacgaacattaatatgaaacaatcttccctcctggatattctctacacggatatcctcaaataatgccttgcgtaccaagtttttatcaccgcaatccactgccatacagccctgataaagaagatcatcttcatcatgttccagaatatcgacattacggacagttatattctcaagaatctctccagccttatcgtccgggttaccgtgtcctccaatgttgatcggatgagcaatatccgcccaaaggattgaattctgtaaagtcacgttacgacttcctccgtaatagttccagcgatgggcatagatggcaatacaatcatcactgttccgcataaaaacattgtctattaatacgtcactgcaacacatcagatctatgccatcactccatcctttacaactaaaagactttaaattattgatggtcaaccctgtagactcaccaccaaatactgtatagtgatctggatttataactgtaataccgtcaatccatatatttttagaatgagtaacttctattccacggatcggatggtcgagaataccacgcccgacaatgcgtacattttcagctttgtcaatcaataatttagcttttacaacagctccgggagctaaataaacagtagtattggaaggaatctgtatctgtgtgttcggcaaatctttcggacgatggacacccggtccgaaatacattactttgtcactgctttcagtataagtttctgtttccaaaggattagcaaacaaatgaagattatgcaaacgatcaccgttaaactcaatcgacaggcattgaggtctagtgagtgtaaaaaagatagcattgtggtttaccgtatgttgtatacctattgctaacggacggattttcacatcctgaatggtgccattgttctttttcaccatcacttctacgggactgcctatatcaaactgtaccattgaagcagattgtacccgatccatatctacttggacttcatattcgaatacatctttccattcaccgcctgcttcacgtactttgactgtataatcatcattatgtggcataccagtgttcaatccttccggataggttactaattgggcattcccgaatgtcgaaaatgcaatagctattgctaacaaacattttcttttacctgataaaactcctactatattcatatcactaaactatgttatattttaattattctgtttattgaagttctttctaaaactatactttctattccacccaggttggcaaactggtaacagaaactatagaaaaaataaccaatgcaaaaaatctcctttattgtctattacgaacaataaaggagatttacctagaacattccagttttttctgtcttcttattttttactttttacatacggttctgcatattgagtcggcagtgctctcgatatgtctttgaaacatttagtaaaactagtatacaatacaccttcctattctttattatagctttattcgaacggaactgccaagtactagaatatgaattgaaaacgtccctgtactacactaaagtttgtgctttcgatctctttgatatgcgagccggggatgaagtagctataattcaatttgacagcaatgtgtttattgatatagtaattcaatccgaaggagaggtctttctgtgttccgccttttattccggcatcattcagagagagataattgaaacgggcacatagttcgagtgcttttccttccggtcttccgggacaggctacttcttcgtcatacagataattctgtcccaacaatagccaggaacattgcagataagctccttgtgccgtatagttctcaaaacccttttcccgttttacatgggcgcggatgtattcaccctgaagaaagaatttatgatagtaaattagcagttcggttcctattttaaattgagatgctgcatgatctacatctgcttgtattaatgtacgattatcaatcgtgctcacgcccggagatttataagtaaacgtattcctgttctcatcttcgggaagcgtgccgtccggtgtacgatggatagctgctaatcctatatgtaccagtttcgcttgctcataaagtggacggtaaaccaaacgtccgtcaatggcatatccttgcgatgcgtttttcaggttgctcaaatcattatcggtaaagaatccgccacacagatagtaatattgggtacgataggaataggctactcccatacgtcggctatttgtcaatgccagcacagctcccggagattggttgaagcgaagatcaaatgtactacaaatcatatcgagactgaatggctcatagaattgtcctatctgaatggaactattcttataggaataggtggcaaaagcatctttgatggctactttgtttccggcatatcccatttccagtttcattccccagttctgataggtagcttttacaccgatgcgaaggtcattaaattccgtgccgttgccaaagttattcggattcttcagatacactcctccatccattaatagacgcccggtgattttatattgtatgccatcgggcagattctgtgccgttatccgggaagtcgttagtattagagatagaaggaaggagaatttcaaatatagtcctattattttcatcgtccaccttttatcaaatttgtgaaaaagtagttggctccataccttctcccgtaaattttatcccgttgctcatttcggcttctttcgctttcttcagttgtttctcttttttatagcgctgtatcaggtaaatcatggagcaggtgaaagcaaccgtacagatcagtcctacgtaaccggataatatattataaaattccaaccagtttatgtctgcatgggcaaattctttgaacatcaagacaagtacagttcccgtatatccgataaaatcaatggtcacaatgaagaaaccgacatttccttttatcttgaaacaagcgatgaagcggtcgaaaaaaatgctttgaaaacagaggtaggcaatatacagacagagactttggacaaacagccaggtgattgcatccaattgcagagaatcataattgaaagatataaaactcatggtggctgtcccaagtacgaccaatcccagcagggcaaccaaaacttttatgttacttttcacaaagaccatcgctccgaataacgccagaattattaatgtaacgactgtatctacctgcgcaaacatccatgaggactgtccgttcatatcaataatcttcaccaggaaatcttccttaatatctctaagcactaccaacattaggttagctacaaacaataatacaagaaatggcataaagtcgatgaacagttctttccgttgcttgccattcagagttacacgactactcttttgttctatatcttgtgccgtaggttgtggcaaacgggttaagctatatcccaaaagagccaataaaggaagtgcaaaagcaccgataagtgccggcatccaaaattcgctgacgttcaatgtattcataacgaacaatccgatggattttgccgttcccgaactgataacaatactgattcctaaaagactggccaaaatatccgtagtgcggcgaccttcgataaaactgaaaataactccccacatacagcccaatgacaatccattgaagaacatggcaaacatattataaggagtgggaagtgctccgaacgcaaccaatgacaattccgctacggcaatggaaacgagtataaacttcaggcgattctctctcttcaattcggaaatcaacttgatacctataaacttggctatcagataacctgctatctgaatgatagtaaccagtactttataatcaaagccgaatgcttctatcccgtcaaaagtagcagctgtgaaaggtttgcgcaatgtataaaccagtgagtaagaaagaagggctgctccacctgcccatagaataaagaggaaatcggctaatcttctgtttgaactttgtttcgatattgcttcagtaatcgttttcatacgttttcgttttaatttctggagcaaaagtagaggagaatagcaagggagaaaatgaattctaaagattcattttattcattatcaggtagaaatggaagtaatattaatgtaacgtttatgtaaccgtaatttcttggaaatggaatacaaaaagggttgcacaatcactaatccggtattgcgcaaccctttttattcgatttcttatttttcttcttattggaaagtaggcatcttgaatctgtacaataatccacctaccatggaagctacgcggtcaggtcttccctgttcggagccatcgtatgtatcggtacggataccgactttaggttcggcatacagatacaaagaagaagccactttcagctttacctgcacaccggcatccagtcccggcactgctcggaacttaccgtaacggcgtaccagtccggccgtaactcccacaaaaggaacaacatctatcacatggtcggggctgtatccttttgccaatgtggccagactcatcatataatccatacccaaaccggcataatgaagattcatcttcgacgacgttttggccttgtacataattgttccatttacccgccatgcagataacggagtgtaccatttacctatgcttccttttgcttctacacctgcattcttcaccaaatctttgttggctacgagcaagctacccaatccaagtgcaccggagatgaagtaacgcttgtcatcctgaccaaacacgctgcgattggctgcttttgaataaggaacaaagcgatagtggaaacctgcattgactcctaccattacgtctttctgcataaagcccagattaccttcaatgaatttatctccatacaagcgaatctgcggttcaatgtacaaaccgagaaaatcattcacatgccataatccctgtatgcctgcattaatacccggttggaacttatggtctgatttggaagtataagcaaggttgacacctaccgaacctattaaatcaaagatacgatcggaattatatccactcatggtagacgttatgttccacaagtaatcaagaccaccactgacgctggcatgtctaagtttgcccgctttaacacttcccggaactacatagttcgtaaagaatccacccgtacccaccaggcgcaaaccggaataagggctcaaccacttaccgatagagacagaagcctgcggacctaaagaaccaaggttttcaagattcgtcttattcaggaacatttgcacaccgattcccgaagtcataaacagattgtctgcgatgtgattgcttgagaatccgttcttcggacgtgccgcacggtcaatcgtatgataagtcaaaccaaaattcaactctccgagctgatccgtattgccacctactccgcgacctcctgcatatctcttattatacacattgaggcgaggttctataaataaatccacagaacggttgatacggaaacttccttgcacaccgactcctattcccggagcatacttggcggttttatccactcctttcgtacctgccaggttaactccggcaataccgatcagactaaatattctgtcttcatcatatccccaaagaacattattgatattcaacagatagtccgcatgcagatcgacatgtttaaagtagccgcttgcactgcccgaaggggtgtctgaaagtccaaccgtcccggacaaacgcagaccggaagaaggactgaaccatttaccgattccggcagagaactggggacctaatcctttaatcgtattcttgattcccggaactttcagtgtactgataccaccggataaagagataaacatatgattcaggaaggaacttttatcgaaatcatcgaaatgaatcttagttcccatcggagcagcaggcatataggtcagacctaccagaaccgaaccagccattttatagtttctccaactttccgtatacgcaaaaccgtcattataccatccgatccgcggttctacaaacaaatccaatgtagaagaaagacgtacatttccctgtaaaccgagatgagcgccgtaataaagctgaccgccgcctttcaaatccggatacttttcggaacgatcgctattgtcgcccaccttagaataaccggcttctatacctgcaatccctactaactcaaaacaacggtttgcattgtatccgtatgccagggaggacatattcaacagatagtccaggctgccgccacccatttttattttagaatcgtagatactcgacggcagataacctaaattcacccctatccgaagtccatgaaccggagtaatccactttcccataaagagatgggcggtcattcccattccatcctgactatctccacttgttaacaagctgtatggccctattccggcagagaaaaagagatgttcattgaatttattgctctcgaacttttcatttgcaggccgtttctgtaacatatattgcaatgcaccataatcctgtgcctgtaaggtaacagcaagcatcaggaagattgccactgctacatatttattgttgattctgaagatattcatcgtttactcttgttgtatatatcattatttaattttctgctcttccggcagcaagtcaataatatcaccgtccaccttcgctacttccaataaggaaggatcaagttcaagggccttctcaatgctcataatcgcatcacctattttctccaggcggttggcggcaatcgcttttatataatattcgcgggcggtctctacatccatggtagaaatcttatcccatgcttcctgattcttcttcattgccagcagcatcaccacctcattgaaagggctggtagccgccaccttttcgaaagcatcattataataaccggccaatgcctgaacaatggcctgcaaatcttcagaaaccgcttcttcgggaaccaaggtcaagactgaatctgcttttgtatatttcccttcatgcagcaaggcaatagcctgattggacaataactccgccggtgccgatttactgacaaacggttcgagaatacgtgaatccggagtatctttctgtatcgttgccactgccagttcattggctgcatacgtaaagttatcataaagttcaagagcttccctacaatacttttccctttcgtcgggagtttttgctgtcgtaatcatacggtaatattcgaaacgggtcagttccttcggattctttctgtaaagttctctaatctcgtcgtccgtcaaagaacggaagattgaataaccatacgtatattgcacctttctcaatttaggcagataagtagccgcaagttccttgtagaaaggtttcgatttcaagaccccattcaaccggtaaggagtagctgcatattgtttgattaagtcctctacttctttagccagttccggcttggagttttttttcagcaattcagctacctccttccaagaggcaaccgatgcatccgatttcacctccaacagtttacgtgtttccgggtccagttgtgccagtatacgttccagggctttatccgtacgcaattttgccagacgaagattcgtcgcgtaagaaccgtccggcgaagccacccccgtaatatgaaaactcttcaaagaggcatccgggttcgtctcaataccacgcaattcctgattcaatcggttcagttccacctgattttgtggattcttatcatccaggtcggctttacctaccaggaaggttaagtttacctcacctttcgtatcccgcaactgcatcacgggtttcggaagatatttctcgtccgtcagactgaaagcggagaatttatactccaagaaacgaagcgggttgaccgttccgcgtgcaatggagaaagagtcacgataaatgatattccggtaattttccatcgccagatgcacatctgcacggtagtcatgttgcagatattctatatagatagaatcatggtaagcaataatatcccccttgcgtgaagaagtagttttcacacggatgtaatcgtgcaaaggatctttatccatatcataatcgtacattcgattttgcgttgtattataagtatccccgtcgaatacaacaggacgcatcaacagacgctttttcagtgtcacatcataaatggaaggctgcaataccaagcgacgatgtgagttaaacatctccttaggcaccgggacacgggttttcagatgaaaataattacctttgatttcgatgtccgtaggttccggaatcactttgtccttcactttggaagtaatcgtaacttcgtccagttcgatgacggcatctttcaatactacattcagaatctgctttcctgccaccttcactgttttgtcttcataaccgacacatgtaaacttcaacgagccgtttttctcaaccaagacactgtaacgaccatcctcgtcggacatttctatacgttcgtcattgaccggattcaacacatttacattcggaacactttttccctgcgggtttgtgatatgcccctgcacgcggatccgttgggcggatacattcataccgacgaacatcatcgccacgagaagtatacctgttaatctatcacgtttcaaattgattttcattctcttttctgactagctaatgttcgttatcgaataatataaacaaaggatacccccagtttgacaggtgcaatggtggtcttactatcgttgaccgcacccggtttcggagtacccttatcatacttaaactgacggtagcgcaacacacccactccggcagttgcttcgatgttccaatgatcgcccagcacccatgcgtatccataggtcaaaccagcggcgtatgcatcgcctttgtgatgcacatcttttaccatcatatcaaaattattcacgaaagcggtgattccaagaaaatgactcaccatcggacgatttagccagtaacgaacttcaggctgaaaatgcgtgaaagtcgttttaaagttgtctgtactgattgggttcgcagcaatccccatgttcaaggagacatgactacccaatacaaattctgcttctacattcggactggcggtcagccaacccaatgcatttgtctttacagccacccgttgtgcgtgcacatgtacaccacaacataataacagaaatgataacgcagctattaccctgcgaccatttctcatcacatataccatcatttatttcccactaaatatttcccactaaatatttacccacaaaaaagggcttactgtccattttatatactacttggacagaaagccacaaaattagaaaaaatatagtattaaaaacgtttaaacacgctttttttgttttttattgcaacaatttccatcttaggccataatataccatactacggataagatatacaatttttctttattaccaatgaaacatcagatacgcaacaacataggctccgacgcagcatcgggttttatcttcttatcgccgataacaaccgtacagggagcagaagaaataatataccatttcccttctttcttttcgagcaatacattagcggcattgtcggtctgaatcattaccccgggtgcaaccaattgggttccattccctaaaaacaacgtccggtttcctgcatattcattgctaataacagcataatccgctttcactttcattccttgataagtagcggtttgtgcagcatcagatagagagaagatatgatctatacgtccgtttttgcttttcacacagattccggcaaaatcttccaaacctgctccttctgcatcaaagtaagagacggactgaatagcagacggttcctttttcgtactcggttcatatatcgagacaaaaggacgattccaagcttctccatgctgacgggcaacaaatgtcagcgtcggctgctcctttatattatagggcatattcggtgtacggcttagcccttcggtcattggcgccaaagccgtaaagacttcacgatccggttcgcctttcatccaaagattcatgtatatatcatcgccgtccttatctttcatatctatggtgaaagttgccttgacatccttattggtcgcagccactttcttatcatataaataggaataagcgtaaagatgtgcgcctgcaaaggcgagttcttccgtaggctggagattcaggtcgctgccatctgctgccgtcaatgtcaaagtctgcccaaggttgtgatagaagtaatcgtgcatcttatcgcctcctttctctttccggctgcggaatacatcgacataataccccgtctccgccccagtagtgacaatactcatcatacgggtctgatccgccctgctttccggttcacgaaaataaaggttactgtaagtaacggacgtaaatgctttgcccggttccgctgatgccgggaaacaggaaagcaaatcaaaagaatggttacttttcatcaccggatagctcgatattccatccacacaaactgtattatgactggggaattgagaataatattccgcataatcaagtccgctatacaggaaaagcccgatacctgcatccggccccagtacgtatccttttccataaagttccatcgaaatgccgttagcgtgcatgtggttcccttcactgccattcaacgaaatcatcaaactgttgcgcggatgcataccgttgcgctgtaccagccatgacacattgggagcataaaacaaaggagaaacataatcttctatctttcccggctgcactttgggatttagcgccagcggtttatcttcaaagaaagaattgacagatacacgcacattcttcttttctgttttatcatttcccaaatccgggttcaggcatttcagcaaagccgtgaaataattttcctgttctttcttcccgttcgcctgtgcattctgtatcatacggataaagaaattcgtactcaaatatcccggatgcgtatctccaaagccacaaatcatacggttgggaaacagatattcgggagtggttgctaccgctttcgacaatataggcattgctttcaccaaatcatattgcagattcgtatcaaactgattcacaaaattggcataatcattgattaccacactgctatatcccggacattctgcccaaattcccgtatttatatcgaaaccataatctgccaatcgcgtcagactccactggcggatgctggaacggttcatcacatagtcgatataatattcacgtccttttccgtcggcatattctttattgtcttccaataccaatccgacattcataacaaaccgtgcctgtagcaaattccagttgttatgaggtacaccgttcgcaatgatattatccgcccatttcttaaaagctccggcgtagatttccattttatccgggtaattggcctttaggtaattatatagaaaatcatataaagggacagcgatatggagtgcgtcttcatggatgacttcgaaagaagtcaatcctaccaatgtttgctgatggccgtgattcaggtcgatgggcacgtttctataataaatgcctgtcatatatgtatcaaagacccctgcggcaagtttagcgaatttctcttcatccgtcatccaataaaggaaagcggcatcacgggcaattcccaggatttcgcagttcaggctttcaatattccggcctgttttggatgggtgtacactttccataggacggtcaggaagtgcattattgcagaaagtgacattcccgtcctcatcatcataaggaacgacatccgccaatttgggacgaccgtgggtggcagctgtgccacgggttcccgtgtagcgcacagtgggataaggagctctttcaccacctgcatggtcgaacgtttcacctttcacatatacttccgtggcatgagacttccagtacattgccaaacgagacagcaaccacgccggttgagcatccgtcaggttcgtatatacttccgtccgttccttcaatttattgaaaacatctttcgcccattcttcttttttaatcagcttccatgtttcctgctttcccgccggagtagtcagtacccgcggatgtgtctgcggcatcttttccggcaaaggaatctcttgtccggatgcgctgttcagaaaagatagaaaacatagtccaagtaaaattcgtctcatacttcagttatattttttaggtttgatacctattaaatacgaagatagagatttatttacctaaatcctccgtcaaagaacaattttatttgtacgagactacgctgttatttcaaacaaagaattatatttgcaaaaaaccgactaacaattctgatacttatgaaaattttatctatccatgatttggcaacaatcaggaagagagcagagcacaatctttcattgcgcgaagaaagtaatgaaaaggtgactgaaaagtgttacggactggcatccggtgcgcaacatcttcagattctgatctgcggtggtacaggctgtaaggcatcttccagccagggtattacagacaatcttctaaaagccatcaaaaagaacgaaatcaccgataaagtagaagtcatcaccgtaggctgtttcggcttctgtgaaaaaggtcctatcgtgaaaattatccccgataataccttttacacccaagtcactcccgaagatgcggaagaaatcatcaacgagcatatcatcggaggacgaagaatcgaacggttgctgtatgtagatcctaaaacggaacataccgtcagcgactccaagcacatggatttctaccggaaacaactccgcatcgcattgcgtaactgtggttttatcgaccccgaaaatattgaagaatatatcgcccgtgaaggatactttgcattggccgattgcctgcttaacaaacagccgacggacgttattgatattatcaaacgttcgggacttcgcggacgtggcggtggcggtttcccgacgggactgaaatgggaatttgccaacaaacaacagtcggatgtcaaatacgtggtttgtaacgccgacgaaggagatcccggtgcattcatggaccgttccattatggagggcgacccacattcgattgtagaagcgatgtgtgtctgcggttattccatcgggtccaccaaaggattagtatatatccgtgcggaatatccgctagccatcaaccgactgaaaacagctatcaatcaggcacgcgaatacggattactgggggatcatatcttaggaacagatttcagtttcgacatagaaatacgatatggagccggagcttttgtctgcggagaagaaactgcccttattcattcgatggaaggaaaacggggagagccgactctgaaacctcccttccctgccgaatccggttatctgggaaaaccaaccaatgtaaataatgtggaaacgcttgccaatattcccattattctaaccaaaggagccgactggtttgcaacgattggcacagaacgttccaaaggaaccaaagtgtttgctcttgccggaaagattaataatgtcggactgatcgaagtgccgatgggaactactcttcgggaagtaatctacgaaatcggaggaggcatcaaaggcggaaagaagttcaaagctgtacaaacaggaggaccgtcaggcggctgtctgacagaaaaacatctggacactcccattgactttgacaaccttctctcggccggttccatgatgggttcaggagggatgattgtcatggatgaggacgactgcatggtatccgtagcccgcttttatctggattttacagtggaagagtcctgcgggaaatgcacaccttgccgcattggaaacaaacgtctgttggaactactgaacaagattacagaaggaaaaggcacagaaaaagacctggacacacttgccactttgggacaagtcatcaaagatacggccctctgcggactgggacaaacctctccgaatcccgttttatccacattggataacttctacgatgaatatatggaacacgtacgggataagacttgtcgcgccaagcaatgtaaatcactattaacatataccatcagtccggaacgttgcattggttgtcatctatgcgccaaaaactgtccggcggatgctatcagcggactggtgcgcaaaccacatgtcattgctcccgataaatgtatcaagtgcggcatgtgcatggcacgctgcaaattcaatgctattcttgtctgctaaaatcttatttactatggaagaaaaacaaattactctccagatagacggtcatttcatcactgtgcccgagggaagcactattcttgaagccgctatcaaaatcggtatcaatatacctacgctgtgtcatatcgacctgaaaggaacctgtataaaaaataatccggcttcctgccgtatttgtgtggttgaagtgatgggacggcgcaacctggctcctgcctgcgctacccgttgcacggagggcatggtagtaaaaaccagtaccctgcgcgtaatgaacgctcgcaaagtggtggctgaactgatcctttcggatcaccccaatgactgcctcacttgccctaaatgcggcaactgcgagctccaaacgttagcactgcgtttcaacattcgcgaaatgcctttcaatggcggtgagctgtcccccccgcaaacgggaaattaccgcttctatcgtccgtaatatggataaatgcattttctgtcgccgttgtgaaagtgtttgcaatgatgtacagacggtcggagcattgggtgccatccgtcgcggattcaatacaaccatcgctcctgcctttgaccgaatgatgacagaaagtgaatgtacttactgcggtcagtgcgtggctgtctgtcccgtaggcgcattaacagaacgtgactacaccaaccgtctgctcgacgatctggctaatccggacaaagtagtgattgtgcagaccgcacctgccgtacgggcggccctaggtgaagaattcggatttcctcccggcactctggtaaccgggaaaatggtgtatgcacttcgcgaactgggattcgactatgtattcgatactgattttgcagccgaccttaccattatggaagagggttctgaaattctgaaccgcctgacacgttatctcaacggggataaatccgtacgattacctatcctgacttcctgctgtccggcatgggtcaacttcttcgaacatcatttcccggacatgctggacattccgtccaccgcccgctccccacaacagatgttcggttccattgccaaatcctattgggcggagaaaatgggcatacccagagaaaaactggttgtcgtatctatcatgccttgtctggctaaaaagtacgaatgtgcacgtgatgaattcaaagtgaacggtatccccgatgtggattattctatctctacccgtgaactggcacgactaattaaacgtgccaatatcgggttccctctcgtactggacagcccattcgacaacccgatgggtgaatcgacaggtgccggtgtcattttcggaacaacaggtggtgtaatggaagccgccctccgttctgtctatgaaatctataccggagaaactttgaaaaatgtaaatttcgaacaggtacgcggactaaatggcgtccgtcgtgctaccattaacctaaacggatttgaattaaaagtaggcatcgcacacggactaggcaacgctcgtcatctactggaagatatacggaacggacataacgaatatcatgtaatcgaaattatggcttgccccggaggctgtatcggtggcggcgggcagcctttgcatcacggcaactcggaaatactctatgcacgcgccaacgcactttaccgtgaagacgccaacaaacctttgcgcaaatcgcacgagaatccgtatatcaagacattatacgaggattatctcggcaaaccgctaggtgagaaatcggaaactctcctgcatacgcattatttcaacaaagcgattgattaacttttaaatgaagagtattatgtcagatatcaaactagcctgtgacatggcagagcaaatcaaaacgatctgcgacaagcatggaaacaaaccgggcgaacttatcaatattttgcatgaggcacagcatttgcaagggtatctacccgaggaaacgcaacggattatcgcttccaaacttggaattcccgtatcgaaagtgtatggtgtcgtcactttctatactttctttaccatgactcccaaaggaaaacatcccatctctgtttgcatgggtacagcttgttatgtacgtggttcagaaaaactgctggaagagttcaaacgtgtattaggtatcgaagtcggtgacactaccccggacggaaagttctcattagactgtctgcgttgtgtaggcgcctgcggactggctccggtagtgatgatcggcgagaaggtatatggtcgattacaaccggtagatgtaaagaagattattgaagaattggaataaccgaattcccgaaaacaatataaaacaaacggctgccttgataagtcaaaacagccgttcattaatattaaaatgtaaaaaaatgatgcggagagaacgagattcgaactcgtgataccctttaggggtatacacgctttccaggcgtgcctcttcaaccactcgagcacctctccttacaattaccaactagagaaaaaactctccataaaaacagaaagcagcaaaaagctgctttctagcggagagacagggattcgaaccccgggtacctcgcagtacaacggttttcaagaccgccgcaatcgaccactctgccacctctccaaaacttctttatcagaagtgcttttcgttaaaagcggtgcaaaggtacgaatatattttaaacttacaagagttttcacaaaaaaaaatcacgaacatcatttccaaagaatagcaatatctaggtattttatgttgaaaagcataaaatagagcatatttatgctgattatatgaaaaaacgttgtaactttgtgcgctctaaagaaaaggataactacaacctctaattttatcatttatggaattaaataagatctttaaagacggtctttggagcactgaaatcaatgtcagagatttcgtaagtcataacatcactccgtattacggagatgcttctttcctcgaaggacctaccgaacgcacaaaagctgtatggaaccgctgcctcgaagcactggcagaagaaagagccaataacggagtacgctcactggataatgtcaccgtctcaaccatcacttctcataaagccggatatatcgacaaagaaaacgaactgatcgtcggtctgcagacagacgaacttctgaaacgtgccatcaagcctttcggaggtatcaatgtggtaagcaaagcctgccacgaaaacggcgtggaagtggacgaccgcgtaaaagatatattcactcactaccgcaagacgcacaacgacggagtatttgacgtatataccgaagaaatccgttcgttccgttctctgggattcctcaccggacttcctgacaactatgcccgcggacgtatcatcggcgactaccgccgtatggctctctatggtatcgaccgattgattgaggcaaaaaaagaagatttgcgtaaccttaccggtccgatgaccgaagcccgcatccgcctgcgcgaagaagtggcagagcaaatcaaggcattgaaggacatgaaggtaatgggcgaatactacggactcgacttgagccgtcctgcctacaccgcacaagaagcagtacaatgggtatacatggcttaccttgctgccgtaaaagaacaagacggtgctgccatgtcactgggtaacgtctcttcgttcctcgacatttatatggaatatgaattgagcaaaggaaccatcacagaatctttcgcacaggagctgatcgaccaatttgtcatcaaactgcgtatggtgcgccacctgcgtatgcaatcttacaacgacatctttgccggcgacccgacatgggtaaccgaatccctgggcggacgcctcaacgacggacgcacgaaggtgacaaagacttctttccgcttcctgcaaacactctacaacctcggcccttcaccggaaccgaacctgactgtattgtggagcccggaacttccggaaggattcaaagaattctgcgcaaaagtatctatcgacacttcttccatccaatatgaaaacgacgacctgatgcgtgaagtacgccagtctgacgactacggaatcgcatgctgcgtatcttatcaggaaatcggaaaacaaatccaattcttcggcgcacgttgcaacctggcaaaagccctgctgcttgccatcaacggcggacgttgcgaaaacaccggtacggtaatggtgaaaaatatccccgtactaaccagcgacacactgaacttcgaagaagtaatgagcaactacaagaaggtattgacagaaatcgcccgtgtttacaacgaagcgatgaacatcatccattatatgcatgataagtattactacgaaaaagcccaaatggctcttgtagataccaacccacgcatcaaccttgcttatggtgtagccggactttctatcgccctcgattcactgtcggccatcaaatatgccaaagtaactgcacgccgcaacgacatcggtctgacagaaggtttcgatattcaaggcgaattcccttgcttcggtaatgacaacgacaaggtagaccacctgggtgttgacctggtctatttcttcagcgaagaattgaagaaacttccggtttacaaaaatgcccgtcctactttatctttgctcaccatcacttccaacgtgatgtatggcaagaagacaggtgctactcccgacggacgcgccaaaggtgtcgcttttgctccgggagccaaccctatgcacggacgtgacaagaacggtgccatcgcctctttgagttccgtagcgaaattacgttaccgcgactcacaggacggtatcagcaacactttctccatcgtccccaaatcactgggagctactgaagaggatcgcgtagaaaatctggtgacaatgatggatggctatttcaccaaaggcgctcaccacctgaacgtgaacgtactgaaccgtgaaatgctttacgatgccatggaacatccggaaaaatatccgcaactcaccatccgtgtttccggttatgccgtaaacttcgtgaagttgagccgcgaacatcaattggaagttatcagccgtagcttccacgaacgtatgtaatcagatctactcaatatgacgataaacgtacattcatacgaaagtatgggaacattcgacgggccgggcttacggctcgtcgtttttcttcaaggatgcaatttccgctgcctgtattgcgccaaccctgacacaatagccgggaaaggaggcacacctactccaccggaagaaatcgtccgcatggctatgagccaacgtccttttttcgggaaacgcggaggagtcactttctccggaggagaacctacgtttcaggccaaagcactagtccctttagtgcgtgaactgaaagaaaagggaatacatgtatgcatagacagcaacggcggtatctggaacgaagaagttgaagaacttttcaaactgacggatcttgtattgctggatattaaagagttcaatccggcacgccatcaagcactgaccggaagaagtaacgagcaaaccatccgcacggcagcatggctggaagaaaacgagaaacctttctggctgcgttatgtattagtgcccggatacagcgatttcgaggaagacatccgccgtttaggagaagctctgggaaaatataagatggtgcaacgagtggaaatcctgccttatcatacattaggcgtacataagtatgaagcgatggagcaggaatacaagctgaaagacgtaaaagaaaatacccccgaacaacttgaaaaagctgcggaggtatttaaagagtatttcactactgtggtggtcaattaaccaccacagtaataaataggataaaaatcaccatgtctctgctttcacctcgaaacagggacactctttgatccgctcccaagggtcaacaattccattataattggtgtcaggactcaaatcacggtgtcccaccacttttgcatccggataacgctgcaacagttcgcgcaccaggcgatgcaaagattctttctggcgggaagtacgcgtatccgctgcctttccgtcctcatccagtccgccttcataacacacccctaaactaatcgcattaaaaccgcgtgcatgagcacccaccgtatcttcatccctcatcggctctatctgtcccgacttgcgaatgtagtaatgatacccccaacacgaaaagccccgaaagcgatgggcagtgtccacatccttcgccgtgaagtcgcgatcagcacgggtagcagagcagtgaatcacaatcagactaatctttctcatcgtccttctccctttccgtcgttttcacattacacacttccttatgggtagcattgaagcgcacctctctcacaattctgttccgctttctttttccgaagaaaggcacaaggaacataattacatccaaaatcttagttacaatttctttcatttgatccaatattaaagttatcatgctgccggatccggagcttctccgcttccaccaccgtctgaaccaccaccggaacctttgtcatcgtcttctccttcattgccgctaccgcccgtttgagccaccgcacgcgtcgttacctgctggtagctaagaatcttcgtgatgtccgccaacgtctttccgggacggaaaataatatgggcagccgtaatcagcgaacttgaaaactccttgaccgacacagctccttcactgttcaacccgatctgcaaactgcccaaatcacccagccggactattcttcccgctttcaacgcacgcttcgcctcataaagaatacccgaaatggcggcacgcacatctgtctccgtacaggtagaccgactggtgattccttcgcacaactcttcaaaatccaactctcccgaagcctgtgcctgcgcgtaatactttgccgactcatcctttttggcaggattcttgcgcggcactactgaataagttactgtcattgccataataaaataattttaagatttcacacatttcgaacgcgttccttatttgttaacgacataaagataacacattttccatcctccggattccccaacgaagtttcctgatactctatgaataataatgacgttattcttttaataaaccattaattttcagtaactttatagcataaaccaaacattattcatcatgtattatccggaccagccgtttcatatccgcacttataaaaagtcggaactagctcatctttacaaccccaacgtatgccttaaagtagccttacaaatactacgtcgttggattgtctacaaccctccgctcctgcaagaactcgaacaagaaggctatcgtgcccgcaaccgccttctctctccccggcaagtggcaacgatcatacgctatttgggagaaccctaggaacttaatcaaaaaaacgaaaagttccattctattattttacaaacaaatttctttgcaaccgcaaattaaaaagaacaaaccaacatggatcattttaccatctttcaagacttttaccgcgttatagccgaaatgacagaagaagaaatcgtatcggccatcagcaacggcacataccgggaaacggtggaggacgtgcgccgaatcttcgcggaacaaggcgagaaagcagccaacgaaaagaaaatagaactaccagaaatcaccttttcagccaactaccggggaggacgttcaaacgcaactctcgtcaagtatctgggatacatcgtggtagacatcgaccatcagacacaggaagcattggcacgcatcctcgcactggcaaaaaagtgtgcccacacccgcatcgctttcatcagccccaaaggaatgggactgaaaatcgtggtacgtgtatgccggacagacgggacattgcccgaaacaattcaggaaattgaagatttccatcatgctgcttatcacaaaatcgcttccttttatgcccagctctgcggagttgaggtcgacacttccgggcaggatgttagccgcacttgcctgttctcttacgatccggatatttatttcaatcccgatgccacagctgtcatcgtggaacagccaccgatgttcttcaagtctcaaaagaagaaaagggcatccggcaaaaagaaaaagacgacagcaccagacaacaatcccctcaccgaacaagtggccctcaactaccattcctcgcacacttccttaatggtgactctgaactattatcacaataaatccgaaaagtacgtcaccggcaaccggaacaactacctgcattgcctggcttgtatgtacaatcgctacggcgtcccccaggaagaggcggcagcttttatcaagagccagttcaccgatcttcccgcggatgaaatggacgcactgatcgggagtgcttacggacacaacgaggaattcgacacccgcaagctgaatagtacgcagaagcgaatgttacagattgagcaacatatcaaagaaaattacgatacacgctacaacgaagtgcttcatatcatggaatatcgcagaaggaaaacggacacggagcaaccggaacctttccatattctcgacgaaatgatggaaaacagcatttggatggagatgaacgaactgggctattcgtgcaccgtcaagacgattcagaatctgatctactccgacttcagcatcacctaccatcctattcgcgagtatttagactcgctgcctgaatgggacggaacggattatatcggtatccttgccaacagcgtgcatactagtcaccagaaattttgggtagaatgtctggaacgttatctggtgggaatgtgcgctgccgccacacaagatgatgtggtgaaccacactgttttgttgctttgcagcgaaatacagaacatcggaaagactacgtttatcaacaacctgctgccgcccgaattgcgcgcctatctttctaccggtcttatcaacccgagcaacaaagatgatctggctaaaatagcgcaggcgatgcttatcaatctggatgagtttgaagggatgagcggacgggaactgaatatcttcaaggatttagtcacccgcaaagtaatcagcatccgcctgccatacgcgcggcgttcgcagaactttcctcatacggcttcttttgccggcacatgcaattaccaggaagtgcttcacgacaccacaggtaaccgccgttttctctgctttcatgtcgactcgatggagtttatcaaaataaactacgcgcagttgtatgcacaaatcaagtatctactcaacaagccggggtatcagtattggttcacccagtcggaaaactcacggattgaagagaacaacgaggatttcattttccactcaccggaagaagaactggtgttgacacatatccgcaaaccggaacgtttcgaaaaggtgcattatctgacggtcactgaaattgcggaattgattcgcgaacggacggggtatcaatattctcacggaaccaaagcccaactaggaaaagtgatgtccaaacacggcttcgaatttcataagggaaaaaacgggagaagatacactgtattcattattgatacggaacaggtgaaatcaaacaggctatatgaataagatttcatctccttcgcacgcaaaaaggtgagggttggtgagggtacttttgcaacttttcatttttatatttcttatttctattcttctattttcttctaaaaaaaaatacgaatgttagaaatttaccctcacctaccctcacctttttcctttttcttcctctttcttcctcaaaaaaacggtgggaaatttgaaaaagacagttaactttttcaaatttcccaccatgtttttttaatcgcttcttataaagacatcgaaaattcgatcctacaacctaacgcattcatgatgcgatagaaggtagaaaccttaggctctgtctgaccactttccactcttgaaatataagaacggtcggaaccgatacgtcgggctaactctgcttgagtaatcttagcctttttccttgcgtcttcgataatttgcccggtgtagaaagcatacgctttttcttctgcttccgcacgagtaacagttccttccttaccaaaacgctcatctattaatgcgctgacgttaaagaattcctcatttgtttttgcttccataatactcctttcttaatatctttgctttttcaatttctttctttggggtcttttctgttttcttttggaatccgttaaagagtatcacaatacgtccttcatcgaaacaaaagaatattctatatatattactctggtactcaatacgaagttcataaagtccttcttctatcaacttcataaacttcaaaggtattctgtcctgcgtttgcaatagcattaacacatataatatcttatcttgggtgccagtatccagacgatcaaagaactctttgaaatatcctttatatgctattatttctcttttcatactgcaaatatatgaattgttgttcaactatacaacattcgtctttttattttatattatttttcctcaaattctccggcacgctttttcttctcataagacaccagcgtctctacactaagcgttttcccattcttagggcttatcacatctacaacgcttgctaacgcacgaaaagtctgttcgcaatttgctattccgtcatacgtcaacctaccccgattgatggcatcgagcacaacagagacatattgcttcggatttccccgatactcaatggtgacaggcgtgagatgcgacatctctcgagtcagttgactgacgattcttttttttggtcgagcagctccattaatttttcactatgcacattgatttgtgcggttacttcacgaagttcatttttcaatgaacaaaacaattcatcattacatgaattttccataaaacttttcatttaattgattataaaaaagccattccggaaagataagcaatcattacttacttcccggaatggtgactaacatttttaagaccagtttttgtatattactgtttctttcaatggacaaaagtagccaatttattcctataatatctttccacctcttcccaatgataatagggtactagctcacttgcaagcggaagtttcatttcttgttcattgagtaaaattttcaccaagatattatcatttcctttcttacggtaaaaaacgaactgaatattacaagcttttggaaagatacgatagttacgccatatatctgacaatttatttatatcagtagtctgatatgcacaatcacctaattccaataaacaagccaaaggaagtagacaagtctcgtgcccgaagcgcagggtagcactattctcttttttcacgacgcaagtatctgcagtattcagtatattctcaagcaggtttgcttccacataaggcatcttaccttgagtgagcggagacggcccgtagtcaatataccaattcagattgctgattagccataaatcataacactcttctttggtaaaaagagaataaagatcaaggtccgtgtcgtgactttgcgtaatggctgccagttcaaacaaataactcatcaacttgccagcatccactttccactttacataattatcgttattaaaaagagacttcatcaaacgttcgggatggagatgctctttccgaaaagctgcctttacagcaatcacttcatcttcctgacgcttctttttgaagtattcatttccataattcatataatacatatcataagaagtagcctcatccttgattctcaactccggattcagagattgcaattgcaagcactcagccgtcatagagagtatacagcggataacggttgtagaacgtgcatccacctctgccgctccctgaaacacttcaggaaagttattgtacattcttcgggcaattcccctgtgttgacgggcacctaatggagtcaaatcaccatatctattttctgctccgcgcgcaaggctgtctacaagccagagggccttcttgcctaaatctgtaagtactccgtctttctctgcttcgcgaagaattgccaacggcttcgtataatcatcaggattcactctataacgggaaccgtgacgagcataatggcttaggtagaacggtttataccccttgggtggggcagtcattgtgaaatggggatcaggataggcataatggttggctgccgagcgatgtatgtcttcaaatatttcatctcttgctatctgtgcacttatactaagcacaaggcaacaaaggattgtcaacaaaataaaacgtttcatactttctttttttaataagtttaagataccacagaattattcactagagtaaggaccaaacctgttcgatataaccaagtctgttttccgggcatccagcacatatacttcatattccccgtctggatatactcttatcacaatgtgcccctgttttgctttcaagctacgggcaaaccaaggaccaatagctacccccgtttcatcatcatagtaagtcataaaaacatccctaggctgcgttccgatattctttgataacaaccgttgccccacttccgctcccggatgatcggtactccatgattgagccactactactttaggatcgagcacttcgagaaagttccggttagtggcatcccgattgctatgatgattgagcgacactgccgacacctttcctattatgggtgccataggagtttctatatcataccattccgcatggtcttggtctaccaaaccagaattatcccctcccgcataatacttgaatgcgccatatttcaccacaatagccgtcgacatttggttttcactatacttgccattttttgccatcaattcttccttggtaaacagaatagtcgtttttttaccttcccctgtccacaaccgattattcgattttatattcctgacttcaaaccccggataagatttcggttctttctttaatacaaattgcgtattagagcctatgtcgaacttttcgactttcaatccgttgtgtttttcctgatagttgaggaactccaataggttcaagaaagtaggcaaatctactccatcattctttgatcgtaaatccacggggaattggtagtcaggataatccctatcaacatacattttgataggaatcacatctccgacttccgtcagccccgtaatacgatatccgtttttggaagttccagtggccttctgaacatcaccataatgatcggaatgaaaatgggtcagaagaaaatagtcaatcactacatcctttcccaatagatttgtcacataattaatgatagacgaaccgggcgtataactactatccggaaatatcggagctgcatgcatcggtgcatacttagcggcatattccttgccatcaaaatcaccggcatcaatcatcatggtcgttccgtcaggaaaaatcagaaaagcgcaattcccccgcccggtattgatgtgatgaatatcaaggtatcctttctcccatttagggaaaggcggtattgtcatttgagccttgattatacaactaaaaacgagtaaaaatatgaaattaactattttctttatatccatcgttctatcaatctgtttataaattactactgtactttattctccaataattattttactccatagaaatggatgatctgaaagactaatgtcttttttaaaaatgctatatgcgatttccgctttcataccagaattcttattgattaatatattatcaatctgcccatatttgtatttatcaatatattgttcagcatcttccacatcatcccatacactcttaaagcctgaattaaagatgtattgcatggcattagtttccggcaaatcattgaagtcgcccatgactatgattcttttactagtatctttcatcaaaacaacatctactaaattcttcatgacagaaccttcaactactcctgcgctacccggaatatgcagactataaaaggttagttccttatttttaatcttggtttcaatccgaatagtcgatgaatgtgtccaaccttttccctccaaagcaaattcttttgactgcaatataggagttttactcaatattactttgtattttcctgcatattttccagttttatcctttccccattcaatccaatgatttccggaggatatatcaccgatataaaaatattccattcccaaagctttacctattattgaataaaactcttcaactccggaattcttatcaatcaaaatgggacattcttccaatgaaagaatatctaaataaaaagactttagactcaatgctatttcttccgctgtcgccgtttgccctacatccacgttaaaagttccgacacgaatagaagtatctattataggggggattttttccttatcattctccggagtatcactactgcatgagaatataaaaggcaatattataagcaaaatattcagatatttcatagctattaattatttagaatcagaccctctatcatttaagatatcatctactgatggattgtaggcattaccttcacaatgataacttactgtaggcagactggttaatattggttttaatgcggaaaggtcagttaatttttcattacctttgtctgatttgtttccacttcttatccctatattaattagtttcactgccgtaagcccttctaatccattcaagtttgtaaggctgggatttcccataatataaagattcgtctttatttcacttaaatttttcagaccggttattgaagtcaacattggattatttctcaaccaaaaattaccgccaatcttctttagattttttagaaaatcaagatttcccagaagactattaccatctacctcaaggtttgtacccacctcggtaatgtttgcaagcatagatacatctgtaatatcactgcctgatgtcccatttccaattcgtaatttaccggtcacagaagtgtatttcaactgtaaattatcgattgccttttgatttggcagcagcaaatcgcctacataaatatgttctatcactccttctttctgtggaatcgttacattaaccgtacttgcaagagaacgtacatttgcattattcacccaatacaaatcaatctcgtagtccgtgcccggtttcaacttttcaattgaatatttagttatagcaggatcaacgatatcaatcagtccgtctccgggattatatacaatgacatacttctttacttccccgtttggtacatcccatgataaagaaatactttcttcaaatacctccgttgtcaaccctgttatcggatctggttgatttatcccgtctttatcatctccacatgaggctaacaataaggacatcgataaaataatgatgaagtttaaaatatctttcatgactctatttttattttttatattaatattccggattttgtttaataacgacaggatttgcattaatctcgcgttgcggtataggatatactaattgataatctttcaccgtgaacttactgctctcctggctgctattattcattgtttcgacagcagtacctgtacgaatcaaatcgaaccacctatggttttcaaaagcgagttccaatcttctttcatccgcaatggcttttctgaaacttgtttgatccggcaaatcgtctgaatcataagtagatactcctgcgcgcgaacgtatactgttcagaagcgtaaaggcctcacctgaatcgtcacccgtatatcctatttcatttaaagcttctgccagcataagaactacatccgcatatcttaaaactattacatttatatcagaatcctgatccttaacggtaggacctacatatttttttgcatataatttattgttgctgactccgattgttacattcttgcgcttgtcatctgaagaatataaatcgtacaattcttgtgtcggtatattctggttgtatacagctcccacaatacccaatgtcggaccttcgcctgtaggtgcaaacagattagccaaagcacttccctcgttttctaagtttgaggtaaagttaacttcaaaaatggattcttcattgtattcattatccggaccgaatatttgtgaataatttttcaccaaagcatatccttttacgttgtgcagtgcttccacagcttcctgatactgcttcaatgtaagatatacttttcccaaaagcgtatatgccgcccctatagtagcccttcctttctcttcctgaatagcaggcaatcttttgatcgcttctttcaaatcgataattacctgttcatatactttagacttattttcacgaccgacacttaataaatctgcggggtctttagtttcggtaagaatcaacggaacatcaccaaacagtctgacaagattaaaataattaagtgctcttaaaaagtaggtttctcctatagtaattgtttttaggggttcatccatagctatattgtctatccgctcaagtaaaatattacaagattgaattgctttataacagtcagtccatgaagcttctatgatgctattgtctgttgctacctgaagtatctcaaattgataatacacacctccacgcactgtggcagacgtttctttcgaattatcagaaggaacttccatcaggaaatggaaattttgtccatattggccgtttgattgcagaaaagcataaaccgaatttaatagctgtgtgaaatcttcgggcttagtataactattttctttagtcgaactggaaataggatataaatccaacatattcgtacaagaagttatagtaaaaataccactaatgagaataaataatatttttttcataatgcaatttttaaggttgttaaaaactaatggaagcacctacgacaaaattcttttctgcaggatattgtcctaaggtcacaccagcgttaagtggatttgacgagccttcactttcgggattcagccccatgtatttggaaacaagaagcgggtttttaaccgagacgtagactcttacattagtcaaaaaggttcgcgttaaccacttcttatccaatgtatatcccaaggaaatatcccttattctaaagaaacttccgtcttgcatcattaagtcagactctctgcttaaagtattcgagtttgacccggcttttgcgtattttccgggcttatcaggacttatccatctgttgttataatattccttggacataacagaccaaatttcactacttaaaatggtagtaggaaggtctctgtttataacatcaacaccgtaaactccctgtatcgttatacctaaatcaaaattcttataaaacaattgaatgtttccaccataagtaaattcggggtgaggattaccgatgatttcccgatctttttccgttatggtattatcgctgtcatcaatgtttttgaaaatatagtcacccactttttgtgagtcccgataattaggtaaagatttcagttgctcttcgttttcaaatataccgatgatccgataaccatacaatgctccgatgggatgacctacttttgtgatatttcgtgccgtaattatttcattttgatttgcccccaatgacaatactgtattcttattggtcgagaaattggcagagatctgataattaaaatctttgatatggttcttgaatgaagctgcaaattcaaaacctttattccgaacactacctacattctgtaaagaggtagaataaccggaatatgcaggtaccggcacttcaagtagcatatcgcttgttttcgatacataatattcaaagtttaaattcagcgcattcctaaataagccaacatcaagtccgacattaacagtattatttttttcccaggataagttggcattgggagatgtgtttggtctcattccggctaccagattgccattgaagttatatttagcgctactcatcagagacaaactggagtaattaccaatctcatcatttcctgaaataccccaacttatacgtggttttaattcactaataatatcatttttcggaaaaaagttctcttctgatattctccatgcggcagaaagtgatggaaatagtccaaatctgttattgcgtccaaatctcgatgagccatccatacgtaaagctgccgtaaaaaagtatttcttcttatagtcatacttcagtcttccaaaatatgagagtaacgcccattgataacgggttgcagaagcggtgtttatagtaagagccgcattcaatgtggggatatcatcattaggaaagttttccgcatcaatagagttattatttgtcgtttctttttggaatgacataccacccagtatttcaaaatcatgttttccccaactcttgttgaaggttattgtattttcagacatccagttgaaggtttcataggtagaagacgcagcttttgctacagtcggagcggcttgcctataagcgccaatcgtagatggtctataatactcggctctgttggatataaaatatcctccaacataagttttgaacgtaagacctttaagtggcgtataagacaagtatgcaccacctagaatcttaaagttttcaacttgattggtcgttaagttggcagttgcaacattgttctccacttctgccatacctccataattttgaaccgcatggatctgtttgcttattgcataagatccatcgggttcatataccgggaagaatggataggaattgtaaatccccattgataaaggagactcttcccagccttccgttatcttatcttgcatagaataattgggatttaaattaattccaaattcaaatttgtttgatagttttgatgtcaaatttactctgcccgaaattctttcgtagtcagaaccgattactattcctttttgtttgtagtaactgcctgaaacaaaataaacggtttgttcatttgcgcctgaaaccgataactcataataatttgtaggtgcatctctaaatatatgatcttgccaattggtatttaccaatccctgttgatgctctaaatatggctttataaaattgggaatttcttgattcttatattgaaaagcttcagccatcaattcggcctgctgatatgcatctacaagatcatattttttctcaacttgttgaacaccataatatgtgttaaatgtgtattgtgccttaccagctttccccttctttgtagtaataagaattacaccatttgcagctctggaaccataaattgctgcagaagctacatctttcagaacgttaatgctctctatatcattaggattgattgaattcagtcccacatcatccgtcaccggtaaaccatctacaacaaccaaaggtgaacttccggaactaatggttccagtacctctgatagaaatctgtggattgccacccggtgctccacttgcttgtttgacataaattcctggcattcttcccgcaatagcctgtccgggatcactataagatatgctttcaaaatctttagacttaacttggctgacagcggttgataaatcagatttcctttccgttccataaccaattacaaccacctcatccaacaattcagaatcttcttttaatacaactcttgccaactgcttgtccttcgccgaaaatgtcaatgcgccatagccaacaaatgaaatagcaacctttgaatcttcctgaacatcagttagagaatacttcccttccaaattggttatagtacctaacgccgttccaaccaccgtaacactcgcaccgataacaggttcacctttctcatctactaccgttccggaaacatttatattccgcttcttctcttgttctttacgaatcaaaacgatgatattttcttgctcctgtttgtaagtgagttccattttgcctagaagttgcttcatgacctgctgaatcgttgcattctgtacattcaacgatactttctgatttaattcaggaagattctcattgtagaagaatttgtaattacttacttgctcgattttctttaaagaggctcttaaagagatgtcttttacattcaccgttatttgagaataagcggtaaaagagacgcttaaaaacaatagcagacaaagagcccgcagtgttttccagttcttacttctccctgcatttgttcgagggaatttctcaaaggttgttctgtttttcatatatcaaaacttttaagttgtttgataggtatacagactgtcatactcgctcgtccaatcgtctatcagactttaactctcgttaacttattcaattcagagaacaaaaaagccattccaaagaagcgggctccggaatggctctattctatattttactcaataagtaattatactactttgtattcaccaatattacgttcttcagcattaaaggagacaccgactttaaccagctcacgcccgtctgtttgataaggtaacagatatcctttttcatctatttgtttcagagcttcgtctactgttccttccagcttaaactcaaaaacataaatacggtcttttgtttccaccacggcatcggcacgcccttttgcactgcggacttccgcatctacatattgtcccatcaacttaaagacaagatagaaaataacctgataatgacgttcagtctttgtattcaattcgtagggaatgtcggcaaagaatgatttcatacgttccataaaagaatgaacgtcgcccgactgaagttcacggacaaacttaacggcgttaaagtccgtttcatcagaagagatgggggtataatagggtatcaggaatttaaggaaaccatatttcacctcgtcattcgggaagcctaatgtatataggttcaatgatttatcgaaatttttaatcgtcaaatagccgctttggtaaatcatcggaagaggattctttgcttcggcccgatattcggcaaagccggaactaccgacttccaaaccgtctatgagtaaacgtaagtcataatcactttgtttcaacaagtctacaagataggtaggggtaccggtctggaaccagtaattatcaaacattaatccatcaaaaacattgagcacactgaagggattaaacaatccatcttcgctatatgtaaagtgatatccatcgtacatcgctgtcattttatcgacagtatcgtcaaaagacatctcctgtacttctgccaagcgctccaactcgggagtaaatgtggatactaattcctttttagtaataccgcagatattggcgtatggaatcttcatacttatatcattcagctgattcaaatcactgaacacacttacttgggcaaattttgtgactcctgtcaggaagatgaaccgaagatagcggtcggaacttttcagtacaccgtaaaaggctttcaggatacgacggtattcatccagcaggttctcgtctaaaagggcttgcagcaagggtttatcatactcatctaccaataccacaactccttttcctgttttcaagcaggcttgctcaatgacatagctaaaacgttcttcaggactgcggtcttttttctcatcgccatagacggcttcccatttttccaaatattggtttagcatggcaaccaaatctgccgccgtctcatatttcttcgcattcaagtcaagatgcaaaaccggatattgctcccatttcttctctaacttttcaattgccaaaccctcaaaaaggtctttacgaccctgaaaataggcttcaagagtagaaataagcagacttttgccaaaacgacggggacgactaagaaaataaggctttcccgtatttattatttgccataaaatagacgtcttgtccacataaagataatttcctcggcgtatatcttcaaatgtctgtatccctatcggcaatttacgctctaatgtattcattgcatcttcaaattagtgtaccacaaatatagacgttattcgatgaataaacaaagatactctatgaaagttccatttatttctccttcaaaacaatcaccgaaccgtccatttcataatagaaaggtgaagtaagcatcagaatattcagcgcattctgtatgccgcctcccggaatggttccggtgaaatattcattaggtagtttattggagtcgaaacgaatctctacgtcatagatacgtgaaagggttttcattatattctccaaagattctttctcaaaatagatatttcctttcgtccattcaatataatcattcggatgcacttgagtggctgttatcttatgagtggctttattatattctattttgtcgccgggcttcatgatatgcgatattttctgcgcatagacccctacttttccttccaaaagaacgactgtcacgtctttggcatcttcataggcagatacattaaaagaagtaccgagcactttcacttccaaatcaccgatttgcacaatgaaggcgtgtttctcatcatgggctactttaaaataggcttcaccattcagttgcacgcgacgaactttttctccgaagttattcaggtaacttaattgggaagctgaattgagaacaacatttgttccgtccggcaattcaatggttgctttatctcctttgcccgctttcacaataaagggtgtttctgccgttggagaagaatctaaaagatagtaagtgaagaaagcgacacagacaggtaataaaatagcagcaacccatttccaagggatgatacggagggggcgcacttccttgcccaaagtctcttctttgatccgggcaaaaagtttatcacgcaacactgggttcatggaggaatccgatctctcaaactcttgctcccaccagtcatgcaactgacggtcattctttatccagtctgacagttcttttatctcgacatccgtgatcgtttcttcgaaatatttttcaattagctctttataatgtgtcttatccatctttccacttatttacaagtatacattttcatcctacttcccatccaaaacaagtattactattacatttcattaacaaaaaaggccaacaaaagggtaattaccttatcataatgcttcatcaactgttcacgcataaatttcacagccaaagataattgggtagcaaccgtactttcggaaattcccatgatttcggctatttctttatttgtgtaattctgccttttgctcaaaatgaatattttcttccgttgcgcaggcagttcttcggcaagagaatcgatatactcattcaaaaagcgcagatcaatattctcttctgtctgtgaatcacggtctacgctacttttcatgagatattcattgtaaacatactctacggtctgacgctgatacatattcatcaataagtttttggcaatcgtacagagaaaagagataaacgaggaagccgggtctactttttcatgcacttcccatatacgaatgaaagtggcttgcaccacttcttcggccatatattgattgccggaagagagtcgcataatgaaattgtacagtttgccactatacatattatacaatctttcgaatgcctgaaaggaaccgccttttaagtcgattaataaatgtttttcatctgtagaatctaccatatcttagaattttgcaacaaaggtatgcagccataggtcataaacaggtgacaatattattaatattttctcaattatccgacttttctgaagaaaaagatagtaaatagcaaatagtaacgccatccggtcaggataatgacgctatccaatcaggatagtgacggtatccgaaccggatggcgttactatatttagtgaggtagttcgtactaataagtcagacgaacacctgcttgtatgttgaagttaaacggattctctttacgtatagtctgtatatcggagccatcattgaaataataagcaacacccggttccacgtaaatacccaaacgtttcgttgcattgatctgcgcacctacaccaccggataccgagaactgcaaaggcttcactgtttctttttcagatcctagctttccataaacacatttctcaaccatacctccaccggaaacataaagagtgacgagtttcttatccaggaagttccagttggcacgcaacggaataccgatataatgcagtttctgctctatctgttgttcttcacctgccagttttgcatccgaagaaagcagcgtataagtcagtcctgtctcaagagagaatcctttagctaaacctttacgaacggacaatccgaaagaaataggctgatgatgtttaatatcaaccacctgttttgcctgacgcaggtaaggtactccatcttcgaaaaccaatgtttggtcattaggaatcgtctccatcagaccgttggaaactgaaagcatactcacacgtgacatataagcatgagatccggcacctacttctgttgaagcacctcctgaatttcctaccgaaagtcccattgaccatgttcccttttgagaagatcttctttctgtcggaatatgaagtttgtctttaccggaaggacgacgcggtctgttattcgatcgctctgtatcctgtgactgtccctgactgacatctgtattttctgcctgcttcggttcatcttttacattttcagtttctcccttcccttttacattcttatcttcctcactcaaagagtcctctccatttcctgtcgaaggtttattttcattaccgatccctaatggatctacacctgttttctgctccgtatgattcctgtcgactttcgccaaacgatctttgcgagttaccggccgtaagacaggttccacagcagttccctgcatatccggttgttgcacacccggcaatgcatcgggcgtggaagccaatgccggagtttgtatatgacgtatttcatccgcagcgggtgtccctagaaaatacagacttactgacgaaacgacagctaatattataatagctgcagcagccatcatccattttcgataaggatatattttcttctccacaggaggcataagttctttctccagttgttcccaaccggaagcaggcgccggttcggaataatccgcaagcttctccttcaacttattcatccacaattctttctcttccatttctatctatccattatgcattatccattcttttactctttttgccaatacactcttcgcacgaaataattgcgaagccgaagatttctcattaatacctaatacctgtgcgatttctttatgcgatttgtcttcaaatgtataaagattgaacacagtacgatagccggcgggtaattcttcaataaactgcatcaacacattttgtggtatcgcttctacatcggaagcatccggctcttcatattcttcgggcaactcttccaaaggtgtcgactgattaatcacatcatttttccgaagatactgtaaagctgtgttgaccatcacccgttccatccaggctcgcaaagagccttcacccctccaggtgaacttatcgaacgaatcgaatatctttaaaaaaccgtcgtgaagcagatcctgggctgtatcccggtcgccggtatagcgtagacagatgccaagcatacgccccgcatactgttcatacagttccttgcgggcccggttattacccagcctacattgttccgacaactctatttcttccattctcttatacacgtgtttaccttataaatgcagcaaagatagaaatactgcatagagagaacaactcttttatcacttttgtttctttaacagatccgaatgcaatattttctatcctcttgcattttcactacagaaaacataaatattataaaatctaaaacctagtaagtatatgaagaaatttaaattcattgcctttatctttgctattatgactaccatgccgattctccagtcatgcttggacgacgatgataattcgtccgatcttctggctatcagcaccatcaatatgattagccaggatagcaaggaattttatttcactttggatgacgggaaaaagatgtatcccagcaactcacaaggatggaacaatgaagattgggtggagggacaaagagcttttgtgatattcaacgagttggaagagcctgtgaatggatacgaccttaatattcaggtgaaaggtatcaatccaatcttaaccaaagacatcgtcacaatgggtgaagatgacaacgacgaagagaaaatcggagatgataagatcaacacgacttatatgtggatcaataaggataataaatatctgacgattgaattccaatattacggaacacatagtgaagataaaaaacatttcctgaatctggtgattaatgacaaagaagagactgctcccactgctgacgaaggcaatgcggaggacgaatatatcaatctggaattccgtcataacagtgaaggagatgatcctcaacgtttgggtgaaggatatgtgtctttcaaactggataagattaaagaccggatggaggggaaaaagggactaagaattcgtgtcaacaccatttatggcgggccgaaaacttatgaagtgaaatttccttagacgactaatctaatgtgaacatgcgaaacacactcttttttaatataatatattaattacgcaaaagagggcggtagttgtgaaactgccgccctcttactttcttctttatattctttcttctaaaagagttatttcttatctcccagataattccaaacaactgcactcaatgcagctcctacaaatggagcaatgatgaacagccacaactgcgacaatgcttctcctccttggaataatgccggagcaatactacgtgccgggtttacagaagtccctgtgataggaatacatacaatatgtaccaatacaagagtcaaaccgatggcaagtcctgccagattgcctgctcccttcttcggatcggtagagccgagcactaccaatacaaatatgaaagtaaatactgcttccgcaataaatgcctgcaacatttctccatcaccaaaaccattcgaacctgtcgctgtaggcccgtcatgagcaccggtagaaactaaagcaaaaagaatagccgaaccgataatagctccgattacctgggaaatcatatacatacctgcatcttttccattcatacgaccagtcaaaaacactcctaatgtaatagcaggattaatgtgacatcccgaaatacctccgatagcatacgccatcgctactacggataaaccaaaggctaaagctacgccgattgttcccacaccagcacctactgtatcagccaaaccaccagcaaagacggcgctaccacatcccataagaacgagcaccatcgttccaatcatttctgcaatgtactttttcatagtaattaatattgtttttgtttacttttcaaaaataagcaattcagactagaaatcaaaacatatccgtattattataacgcaactttgctacattttttacagaaagagattgttctcgatggaaaaagggattccctaatgtgctataacaaacattgtatggactgtaaagaaagcatttccttgggaaccgccgcctttatttcctctttcaggacgcataagagactgtggcgaataaaatctttatttgttaccagtaccacttgccgtgtaggtcggggaatggcaaacggacgtaccaactgccgctgttcttccgtcaattgcatcactgccaattcgggaataaaagtgattccttttccactttctaccattcgcataaaggtttccatacttcccaaacgataggccatctgattaaccttcacggcctccatctgacagaaacgaacgagttgatcgcgaaaacagtgtccttcgtccaaaagccaaagatgttcgcctgttatatcagaagtacggatcatatcatgcttgaaagaggattctttccgtgacacataagcgtaaaattgctcataaaaaagagtttcttctgtcaagaacgtatcttccagtttgctggcaataattcccgcatccaaatctccggtatgcaaagcctgctgaatatcctgtgtcttcatttccgtgacacgaatatccagttcgggatatttttccattagttgaggaaaaaagcgaggaagtagatagggagcgatagtgggcaatactcccaagcggaatacgcctgacaatgactgtttatcttcactgattatttctttcacttgagctgcctgcgccagaatcacgcgagcctggtctatcactttctgcccgatgggtgtcggacaaacgggttgcactgtcctatcgaacaactttactcccagttcatcttccagtttctgaatcattgcactcaaagtaggctgcgtcacacgacaatattcagctgcccgtgcgaaatgcctgaactggtctacagccagtatatactctaattgttgtatcgtcatctatcaaatcttattaagttatagattttatctatgcaaagatagaaattttcagtttgacagcaagcattttacgccttatctttgcagtacagaaaaaaagagaacaagtataaatcattaaaaatagaagaatatgaaaactttagaatttatcaaattgaacgaatcgggagcaaacaacgtagtagcatctttgcaacaactattagcagacttccaagtgtattacaccaatcttcgcggtttccactggaatatcaagggacataatttctttgtactccacagtcaattcgaaaagatgtatgatgacacggctgaaaaggtggatgaaatcgcagaacgtatcttgatgctgggtggtactcctgccaataaattcagcgattatctaaaagtagcaaatgtgaatgaagtggataaggtaagcaacggagacgaagcattgaataatatccttcagtctatcagctatctgattggtgaagaacgtaagatcttatctatcgcttctcaagccggagacgaagtaaccgtttcgatgatgagcgattatctgaaagaacaggaaaaattggtttggatgttggttgcttatagtagcaagtaattgaaataaaaggtttaggttttaggtgagaaagagaggatatttccgcaaaaggaatattctctcttttttattaagagaaaacgaaacaggaaatctcttaatatagatattaataaaaattactccactaaaataacattctgcaacctaatatcattagaagcggcaccaatcataagatggaaatttccagactctactactttcttcaaagtatagttaaccaagaaaaagtcctcctctgtcaaaacaaaagtaacttttttctcttctccttttttcaaatggaaacgttcaaaatgtttcaactgtttcatcggctgaacaactgatgcatattcatctctcatataaagttgtgatacttcttcgccatcatacttccctgtattctttactttaaatgagacttcaaaacaacgagcagatttctgcactacctgcaaatcagaatattcaaaagtggtataactcatcccataaccaaagctatataacggagaagatgacacttccacataatcatgattccgaggagctttctgattataataaaccggaatctgacctacagaacgcggaacggagattggcaaacgtccagaaggattataatctccaaagagaacatccgctatggcatttccaccctcctgccccggatagtaagcagtcagtagtgcatcagcatattccgaagcccaattcttttctaaaggacgaccttcaatataaacgacaatcaaaggcttacctgtcttttgcaaagattccaatagttcttgttgtctaccaagtaaggataaactggcacggtcaaatccttctccacactccatatcacttacactaccctcttcagctacagccgcacctgtttctttatagctcgttttaaaatcacgggcactggaaccacccacaaccacaattacaacttcggagcgacgggcagcttcaattgcttgttctatctcattcactgtagtatcacgaatagcacagcctcgtacatattccacacgagaaggagataattttgttataattccatcaagaacagttttcacgttactatcttcctgcggagctgtatagtcccctaacatattatatcgattgtcagcattagggccaattaccgccaccttatttatcatcttgcttaaaggaagaattgaattctcatttttgagaagtgttatggaagactgtgcgattttacgtgccagttcgatatgttctttacggcgtactgttttagcagcaattttcggatccacataaggatgctcaaacaagcccatctcaaacttcatccgtaacacccggcagacagccgtatcaatcacagccttatccatttgtccggattgaactgcatgacaaaggttggtataagcatccccacccaagtcaacatcaacgccagccattacagattgtatggctgcattctctttggttggagcaacaaagtggctttcgtgaatcccttcaatactatataaatcggaaactacaaagccgcgaaacttccattcattacgcaagagttgagtcagcaaataatggttcgacgtacaaggtatcccatctatcgaattgtatgaagtcattacagacaatgcccctgcatctattgccttacgaaaaggaggaagaaaattctgatgcaaatcacgaatacccactgaagcataattaccattctgtccaccctccggcacagcgtatgccagaaaatgtttcaaggtagctatggtagcgtatttttgtgatagattacctccacctaaaccgtcaaccatagacgcccctaaagtcccgcttaataccggatcttccccaaatgtttcttccacgcgggaccaacggggatcacgggtcagatcaagtacgggaccgtaactaatatgcccaccttgggaacgaatttctttagcgataacttgaccaacttcttttactaactccggtgaccaggtagctgccattccgatacccgtaggaaaaacagtagcaccaattgccatgtgcccatgaggggcttcttctgctaaaaacatcggaattcccaaacgagtattctccatcacatatttttgcaatgcattccctgcttttgctgccatctcgggattaagtccatttgccagagttttttttgtccacgggtctgcacgataagtcgcccaaagcattccaacattcctttctttaatcaattgcttgaattttccggaaggacagacctcattaccatgtatttcatacatttcccaacctaaaggacaaagtaactgaccgaccttttcttctaaagtcatgcgggaaagtaagtctgaaagtcttacatctattgaaaaactgggatctttgtaagcaggtaacgagggaggagattgagtaaaccccaaagtacataccatctgtactatcaccaaaatatacaatcgttttatcataatgttatatacagtaaaatgactcaattaatttatagtgtatttcttctaatctttcaaatagagatattcaaccctacttacccatttccccttcaaatataactgtatgtacaggctgatgagcatcatttgttatcaacttgacctttgcatccaatagatggtttgaagatgatacatttaattcaaacagaacctccagacactcattttgcttcaaaaccttttcaccccggatattagtagaaacaaattctggacattctattttgcggataataagaggattcgccccttcattagtaactttaacttttctctgaatatgcttttttaatgagatattcccaaaattaaaataagattgtgaacacttcatccggggagcagttgccgtgcttacttttctcatatcatcaatcactgtaccaaagatttgtataggagaactgtgtacggaattggcactaataataatcttatctttaaatgtaccgtaaaagccttttaaaggagaagctgttatttttatagtcgcacaagatcgaccttgaagagatgatggcatagatatcgacaaacatccactcttatccaacagcgagtatgacaacctgaccattttatccgatcggttatagattctaatttccaattgttttggcctcccattatgctgtaacaaatcataagatagagtcattcggtctgccagaatatctgatgataaagaataaggatattcatcctctatacgattcattgtatttatcgtaccttttacccaaagagtattgacactttgccctgaattagaaacaacccttatactcttagagaaaaagtttgttcgccctttaggatcgaaagttacggtaatagtgcctgtatgccctggttttacaggttgtttactataaacaggaatggcacacccacaagttgaaatcacttcttcaatcacaacaggagaagtatgtatattagtaaaatgaaaagtatgactcactttgccttctacttcctgaatattaccaaaattccaagtagtagtatcaaaacgtaatacagtttttccctgttgttgagcacatacgccaacaatagagcacagtaaaacgatcaaagctgacataaaacgtttcatcatcatttctttaagttaatattgggagttacgtaaaaacacaataactcccaatataaaatcacattttaattatcttgaggcaaatcattgaattctgcattccaaatgatatttgccgaagcagggaaagttaaatcacgcccattgcccgaactgtccttcaatgtatttccttctccttcatccaatttccaatagccatataagtccgacgaagatggagaagctattgtacgcaagttagcttttacttcttccgccgtcagacacttcttccacatacgaatatcagaaatcagaccatcaaaatacatacttgaacttgtattaccaaactgaataccagtcaacgtatatcccaccttgaatctttgagaagaggatggtccccaacgtttagtaggttttgcagaagcaacttcctcaccgttaatatataaacgataagcaatctcaatattctggcccgtttttgttccgtcacaagtaatagtcaaccttacccattgattagccggcaacattatattttgattagccaatgtcaagtcacattgacgattaccaatattagacgctcccgttgcaccggtcacacgtagttcacaaccactaaaaacctcattattattgttggtatccttaccacgccatgtacctatataattagttccactgtgccaattatatggatatacaagcatttcaaacgtatgtgtattatcttcaatcgtaactacttcatcatttgcgaaacttaacgtacgatacatatccgttgaataagaactcatattcaatcccggtatataatccaattccccatcaatgctaatcgtaaaataagaaacagaacgagtgtccgttacaaattgtcctacacacgtttcatctattgttgcaacaataggaagcaaatattcttcaccttccaccaaaccgaacaatgatgaaaacttaactgataaggaattggattcttgctgtcctgccttcactatcgcatttttagcttgcaactcatagacaaaagcgggcatcatcttataagacgtgttatttgcagcgttataagcctctaccatactttcgtccacggcaatgtcacacaataaagtagtagcagcaggtttatccagtttgatagtataatcataaacatagcttcctgcatccagtatctccctataatcaatagaaacaggtcctgcctccgactgtggcatctctattgtcggcaattcaataaaatcattgtcatcatccgaacaagatgtgaatcctactcctcccaataaaacaagcaaaaggagagttaatctatttatattgtttttcattatcatacagtctattcatttattattaccttattcaagacatttattcgtatcatcataagtccagtcaatcgtgattccattcttataactgatatcacgctttgacggagataaatcatagaaagtagttccttctccttcattcattctccaataagacacaagcccattggtagaagggtctaccccacatacatttgctttaatttcacgagcagacaaaggacgagtccaaagacgcatctcactcaaacgaccataaaacaattgtgaagattgataaccttttgaaggcataccgatctgtactccataaagcgcatattcatacggagcaactgtcattgagttatctttctctccattgatatacaatgtcaacgtactgccgtcatttaccaaggcaacagcataccaggtatttaaagcaaagcgagtattcgatgacattttaccctgtttagttgttacatgcaactggttcggttcatccgttccttcaccaaaacgaagcaggttctggtcacatttaaagcctccatcatcaatcgctcccccttctacagatgcttcactacctccaaatgagcaaacacgggtagtaccggaagctccggaagaacggaatttagtggcgtaaatcttcacttcccatgtataagtaggcaaagaaggaataggatccggaagcaaaaattgataagccatagaagcctgtcctacatacggagcatggaaacgcaatgttcgagatactttcaggaaaatagtacgccctgcttctataatatccaaatctcccgtcgcactttttatggtaaccggtatcaaataaacacgtcccggaacaaattccgaatcatcggcaattgaaagagaggcagcagaagaaattgcctgtcctgctgaaatagtaacctccggattttcaaatgtatatgatttatccggaatgggataataattggttcccatttcctcattataagtatcaaccagacttgcatcaacagccagattcacctgaatatccgattcaacgcgagaagttgaagtcacagaaacagcatacgcagatggaaatccatcaatggcaaactttaccaatctatccgaagatgttccggtcattaacaacccgtcacctttttgagcggcttcctggcatccctgcagcataaaagaagctattcctatcaaagcagctccccatatcttttttatattattcaatgttttcataccttgcatacaaatttaaaattcatccattttcttcttccgtttcttgtttagtagactgttgtacaggctttccggcaggattttgttcctgaataccacgtcgaaggctataataaggaatagcggctttctctttatcacctatagcctgattagcaggacgagtggtattgtattcatattcaaaataatatccgccgaatccgccttttcgtccttgtgtaggattccagcgtgccatacctattacagaatagattggattgccccatgaatctactttatttccatcggcttccgtaaattcgactccaccattctgccagtaccatcccatttgttccgtagcaacgaatttttcaggaggacaccagctgctaagctggtcaaatttagattgcaaactttgagcactaccggtggtgtaacattgtcgtacaaaataatcgacataaggttctgtttccttaggaggcagctgattatagaagtcaacaattaataatttgcctgtacccgattgaggaccgaaataatttcccaatacctttataaactttgtaaagttatcattttgcaaccagtcgccttccggttcgtagtccaagtccaaaccatccagatcattacgcaacacacatctcgcaagatgcaaagcataagcctcgatacctgcgtcggttttaggaaactccgtacttccaatacggcaaatcgtacacatcacaacgcgagtcccctttactgtacggatataattcatttcctcataagcagtcggcaaataacgctcgttataataactcgtttctacataagccggattgttggaaggaatacctgaccacagactgacaatgtccagactatccggcagaccagtgaaatgaagcccctgcgaaggagatgcttctgaagtataaccggcataccagccgaaacaaatagcatgatctgttttcttatattcacgcaggttctgataatattcttcattataagtattagctgcctgtataacttcaggttcaatatccgtatcacaaccactcacaacaaatgtcaagagacaggtgaacaaaaaatatacataatttcttttcatattttgcattatttaagtaaccaattatttattaggcacatcccaccacaatctgacacccgggttatctacgccacctaaaagtgtgatgcctttatccaactctgttctattcgtattatattccgattccggataaggtaatctgcggatttgtatatttgtgtctacagaacctccggaactttcgttcacaacaaccggaaatactttcgggtaaccggtacggcggaactctgtccatgcctcttgtcccaccggataaagagcaatgtacttttgagtaatgatttgttccagatttgttttaaaatctcccgattcatcccaagcgatagaaacagtccccaaagcatccatggaatgagatgatgtcaccggatcctcataattggcaggcacatatccacccgccgcagttcttgtcagatacgcgtcagctcctgatacaccatgttcatcaaaagacattcttattccatcttcataatactttttagcatcggcattcgttccccaacgcaaagcatattccgccaacaagaaatatgattcagatgaacgcatccacactacattggaagtagcggttgcctgtggttcggcaaagattcctgttatatatttatccttacttacgtcctttgacattccggctcttataccccgatattttccacccgtacctgcctcgaagtaagcagaaagtcgtggatcctgataaccattcatgtatgaatccagcgtcgctcccatacaaatatcatcccatcctttcagaatatacagaggactttcataagtcgctatcggagtaatatgctgaagttctgctaaatcagacttcacattcatcaatccataactattgccaatagccagttgggcttcactttttgcctttgtttcatccacataggcaagatgcaatgcaagacgcaaacgaagtgaattggcaaactttatccaagatgtaacatcaccgttgaacacacaatcccatgatgacaaaactttacttccggatgcagcataactatccaagttattgatagctccatccaattcttcaaagaatctgtaataaacatccttttgcgaatcataaggcacttcttttgaaactccaaaattcaaataaggaataggcccataggtatctgtcacacggtgcattgccgctactttcagaatctgcgccatagaaaaccggggatcttcgtcattgttaatcgcttttcttatttcacgccaggcattcatagtcgtcaggtaattggtagtgaacatatcaccataccaacttcttttatcccaattgtaacgaccggcagaattgatactgggagcaggaaaaccaaaatagccgacataaccatctccacccatcacttccacagtctgatatctgtccgaaccgatattaagtcccggttgtgctaccaccagtacgttctgctccatctgtaaaagaagagaaccagttctcacattatcccaatccgtcatctcatcggttgcttcattaggattggtattgtactccagaaaattcttcgtacaacctacatttatcatgattactccaaggagtaagtagtagttccttactttaaaaaacttacgtatgttcatcattattttttttaaaggttatccaattagaaagaaatctttgcagaaaatcccatcgatctcaaactcggttgcatgaaatagtccataccctggttataagtacctgtacttgcagtagattccgggtcaaatggagccttacaatacagcatccataaattacgtcctacaaaggacacattcaatccagaaatccatttacaccatttattgatcggaatatcatatcccaatgtcaattctcccaaacgaacattcgtcatactatatacatacatagaacctacataacctgtaccattagctccgatagtctgataccatgtctgggcatcaatcatctgaccgtttactttcacgccaccattatcccgcgcttctgccgatgttttagacactccataatagtccattacagcttgagtggcagaaactccgataccacctacacgggcattcaacataaatccgagactgattcctttccaattaaattcatttctccagctaagagtatatttcggattggtattaccagcatagacataattattcttatctgtttccaatgtacccgtcattgaattcatccagatatgtccatgctcatcagttctcattgtattcacatatacatctcccatagagccccctactgttagccgttgtttggcaccgcctaatgaataaacatccatttcgtccagatgtactgtcactcccaactcttcatttgtatattcagggagtaattggtcaatgcggtttctgttgagcgaccatagtaaagttgttttccaatctacaggccctatattctgtttaaagccaagagctaactcaatacctttattcgttactttacctgcatttacatataatttagaatatccggttgttgtagaaatttccggactgaagagctgattctccgtatatgtcttataagctgtcacgtccagtgtcagtttattatcaaacagacctaaattaaatcctccttcccatgaatgagttctctccggtttaaggtcttttatcgggaaataagaagtggtattcaatcctcccaacactgcgtacgtagtgatagctctgaatctttccggtgcattacccacctcactatatgaaaggcgaacctttgcataagaaagaatgttagatttcattgtaaacatattagtcagaattgctgaagcaccgatagaaggatataatatggaagaatggtttgttcctgccaaagcagatatccagtcattacgtaacgaaccatctacataaaccatgcccttatatcctaatgagaatgttccgaataaagaattggtacggtcgtgatagttcgtatttttataggttaatttaccggaaacattcgcattgttagaagtaaacagattaggaatggtcagtaatcctcctccaaaattaagctccttataatccaaatccaataaactggcacctaaagatgctgtcagattccatgtgtcgtgatagaaatatttattgatattcaacatggcatccgcatatatctgactggtattcttgttcgattgcacgtatgctcctttatccgagttttcagcaatcacattcaaagtggaagcatacattttcttttccgagttgatagtttccttatccagtttcacgcgtccggaaacattcaaccaatctgttatcgtatattttagtgaaccgcttgccagaaaacggtctttcttgttggtatacatattccggttcgtaatccagtaaggattctgcatggataatccattttctttcaatggccagaactgtgtttttatgttacggtctacatcatatcgttcataatactgatatttcgagaaatcatcaccgcgcggaaataaataaacgggaaccaatggattggcatactctccttgcgacaacatattctgttcctttacattagaatacataaaacttaaatccatcgtcagtttatcattcagcatagaggtcgtgttacgaacagagaaattatatctgtccaagtcattattctgaatgataccccgggcattcacagcacctacggatacataggtttgatttttttgtgtccctgtagtcagacttacagtgtttgctacattgtaacctgtctgaaaaaaatctttaacttcataatcggtaggagatgacaatttagatgcccaactataccactctccagtttccgaaccatacgtattctggaattccggcaatcggaatggtgaatagaaagttgaattattactgtaagtcaatctggttttatctacagctcctttcttcgttgtgataagtaccacaccattggcagcagccgaaccgtatagtgcagcggcggccgatccgctaagtactgaaattgattctatatcatcagcgttgaagttagccaatccgtcaccggattgtccggcacccgtatactgatcgtcgggttgttcacctgatatattagccaaaggaactccatctactacatatagagcgttgttattacctgatatagacttcgtaccacgcattaccacacgggcaccgcctccaataccggatgaacttgcattgatattcacacccgccaccttaccggcaagactgctcatcacattcatatctttcgcctttgccacttcgtcgccgccaatctgctgcacattgtatgtcaaagacttggtttcgcgtttaatgcccaaagccgttacaacaacctcattcaagacttttgcatcttccgtcatcacaatggaaagcgatttattatctgtaaccttcacctcttgagaagcatatccaatataagagatctccaataccgctccctttttagcttgaatctgaaagtttccgtcgaaatctgtaatagcaccggtagttgtcccttttactttcacattcactccgatcaaaggttctccttttgtatctttcactgtaccttttacctgaatagtcggatcttgctctgttacattcaatttattggtagacaagataatctgcttatcaaccactgtataagtaatgttggttcctttaaatacctcatcaagaatatccaggatcttacctgaattgtttctcacagaaacaatacgattcttctgaattgttttatcattataaaggaaaacatagtcggacgtctcctctattttattcagtacctgttctacagatacattgttcattgaaatggcaacccgcgttcgctgggcatagccatcttcggcagaaagttgtaatactactgcgaaaagtagtgctagactaatcctcataactaaaggaagttttagatttaaagcatatttaggacataatgctgtaaatgaatgattttttttcatacatttgtggctaactaaagtttattactaaatgaactatggtttgattccggctagtgtttgcgagaccttgtaccgtgaatctggaaaattcggaggaagacagctgttggtagcagctttcttcctttcttttattctcttgtgttattccatgggcttttattttaagggttactactctaatataaatctactctaattttagtctttgataatgtatcatctgcctgttgttgcggttcttcaattttccattttaaatcggcagacctggccagataatccaatatctgcgacagagtttcagtccggaaagtagcccggtacttatattcttttccagacctattgttaaactgaatttctacattgaaatgtcgttccagacgcttcaggatttcttctaatgaagcatttctgaaaattagttttccatctttccaagctatctttccatagacatccactttattttttttcgacttttgactctgtttgtcgtaaagcaactgttctccaggagccaatacgattgtttcctgatcgggggttatcacatttaccttacccttttccaatactgtttctatataattatcatcctcataagcagctacattaaatttggtaccataaacatatacgctcaagccattcggagtatttacatagaaaggacgatctttgtctgcctgcacttcgaaatatgcctcacccttcagttctaccaaccggttgtctttcttgaaagtggtaggataacgcaatgtactacctgcattcaaccatactacagaatgatccggaagttcataacgtatgacagaaccggtagcggttaccacctctgcatatttctcgtcggtttctgttccactaaaatataaatatcccaaaaccagagaagagagaaataaaggtatagtcagaaatgctgcataacgcatcagttgattatacatattctttcttctattagtttttattgtggtttgtgcttgataataggcacccaatacatcaatggattccatttctttaatatcatctcccaatgcttgtgctttacggagcaatgattccggactcatattttccatattttctttcaaaatcttatcttttaattgtaattacacttataatacaactgaagtaattggaaaaggacagcaaaaacaaactttttttattttatttttcgagccatgccaaattgaagcggtaatgcaatcggctactaaggatatgaaccacattatcaggagtttgtgttcctgcaagatagccacgtggttcagcatgattttcatccatttcgaaatatcccgtccatgctccaccgtttaaaaaacgatattcaccgtccgtcagtagttttcttaccggccatgtttttccctcatcgtaggaaagagccgcatacatgccatatcctttcttcacatttccatttttatccttaaattccagaccacgttcttccaaaggcgtacgttgcggatggtctgtgaaagaaaccaatagcaaaggtccttcattcagtctcattaaaacaagacgctgacctccgtcaataggagggagttcgcttgctacatatttccaggtctttcccatatcatctgatatgctcattggcattcggagctttccttctttattccgtatgctattaccacgccccatagccatcaaacttccgttccctaattgtacaattcccgcatggatacctgcgattgtacttcccgttcctccttctttgaaatccggcaaaggagcgccatcccaaggatcgcaccatgtttttcctccatctttactgatttgaacagctgccccgtcatgactgccgggacccgcatcacaggcttgaaccagccatccctcacgtgtgcgaatcgtaccagctattacctgatgacgtttggtatgttcgggagctatcagtttaggagtgctccatgaagcaccgttatctgtgctggtacgtagtaccattgcgagattctgccagtctcccgatgcttccactccattgatatgatacaattttcctttcccgtcattgagcaaagcgcttcctgtcatattccgatccggaactttaaagaataaagaagccacatcccaatcagtgtgcccggcacgcaagcgggaaccgagtactaccatccctctcccattctcttcatttgcagaaaaccatattgccagcaaatctccattatcacaccacgtaactgcaggctgatgattatgcagataaaatggggtattcgaatcacataccggacgtaccacaaatggtatcggaggcaaaaacatcggtgtgatagcagatacttttttccattttatagatgtattttctacagatttctgattgaacgggacaggggcagatgttcccgatacattcaaacgagtatctgcttccacaattctaaatccggtttgggaatgtttatcttccgggagcatagccagtcgattggcacttcgcaagtatttctccggggtgtgatgactccctcctcgagtgacccgaaactctccggtcaacggtcctgccgggtctttctgcttttctgcggaataaggagcataccaatccaagcaccattcttccacatttccatgcatatcataaagcccgaatgtattaggaggagtctgggctacttttaaagataccggatcaaagtcacgaaccactttttgattccgatgataaactgcaggtaacccgtctcctgtagaaaatagtgtgtatgtgcctgcccgacaagcatattcccattccgcttctgttggcaaacgatagtttttgccttctttccggctaagccattcacaaaaggcaacagcatcggaataactcacattgacgactgcttcatcatcttccagcgaaacaccgttttttcctcgtaatgcccgatgttccggacggaatgattcatattgcgcattcgttatttcagtgattcccatacgaaacgggcgagagattattacctgatggataggagcctcatcaaaatcttcgcctaatccgtcacttcccatataaaaacttccggcaggtatttcagccatcggaataaaagacttggaaactccttgagaatgtattggcaaacaaaaggttatagccaataaaaaaaacttgtttttcatattttaatcccgtttatatataatacaatcaacctatatacaaaaggacagcctcatctgattattttctattcattagtgttgaaagcaaaaaaaagaatcgaaaattaggctttgataattatcttattatatatttgcaacgaaatgaaaaactacagaacctcaaaataatgaaaatatctttttctaaacagactaaagaacgggctttcaaacaactttatgaggagtattatgccccattttgtttgtatgcaaaaaggtttgttgatgataaagaaacacgtgaagacatcgtttcggatgtattcacctcattatgggataaactggatactgattcttttgatcttcaatcgaacaccgcattagcttacatcaaaatgtgcgtaaaaaatagctgcctgaatttcctgaaacatcaggaatatgaatggagctatgcggaaaatatacagaagaaagctcctgtctatgaaacagaaccggatagtatatatactcttgatgagctatacagaatgttgtatgagacattaaacaaacttcccgaaaactatcgaacggtctttattaaaagtttctttgaaggcaaaactcatacagagattgcagaagagatgaatcttagcgtgaagtctatcaatcgatataaacaaaaaacgatggaacttttacgtaatgaattaaaggagtatatgccactattactcttgttatttcttcgtgcataatctacatcctcatgttctcttcctggtatatgcctttcttttgaaaaacagtcgtactctatatatgtattagtcctgttgtttatatcactctgcttaatagttagcaggggcttacttgtgtggacagataagctatcagttgtgaacaaatccgtttacggttgtaaacagatttgttcacatgggtgagcccttgtaaaacattagagcttaacaaaagaatacctaagtatcaatgtatgatatatagggaaatatagtataaattagctgggaacaagacgagccagggtgagggtaactttttaccctcaccctggcctcacctctaccctcacacttgaaacaccgatgaataaagggattgaatcaaggtgtgagggtgtgagggtaaaacgtcatcaacatttgtttggctaagatgcgacactctgcccggtttatttttccgttctctgtttgcggaatggattctattgtcaatatatgcttgggacgataataaggttccagtatttcatgtagtttatttccgatttcttctgtgtcgggctgatctgccaataataaagtgacagcctgccctaagcgctgatccggaactgaagtaatgacaaaggacacaggaataaacgggcggagcaacttctccatctcctctgcttgaatcttaattcctccactgttaatcacattgtctttccggcctagaatcataaaacttccatcgggatagatacgtgcaatgtcattggtctgcaatgtttcgtcacataccaaaggggcatcaatgattaatgtattctctgcggataaagacaattttactgaaggaaatggataataatgttctgaagccgatgctccgttcagacgacgaagggcaatatgcgacaaagtttcagtcatgccataagtggagtaaacggcagtcggaagatggtttatctccgtttccagagcctcatcaacagctccgcctcctataatcagaatatccgtttgttttaatcgctctttttcttcgggaacctgcatcgtgttataaacttgcaatgggaccattgccacaaatctcaaaggttcttttatatccgccaacggatgaccggaagcaggacgaacaatcaggttcaaacctgcaaccaatgaacgtacgaccaccatcattgcaccgatataacgaagattcatacataataatgccgactcacctttcttcaaattcagaaattcacaagtcagacgcgcactttgcatcatttgatccttgcgtaccatcagttctttaggtatacccgtggaacccgatgtatgaaccgtgatgacaggagagccattaaaccattcgttcaggaaaagatataaatcccaataagcagaagaatgagcttctgctcctcctgctatcaattggcttatatcttcaaaagtgtattcttttccttccagtagcaagcgctgttgttgtcgatcgaatatcatctgaatatcctttaaataccactaaataccatcatttacaaaaccacaggcaatcttttctgatttcaagaggcacttctatattgtcagtaaagagcatacccgttcccaatccttgtggcaacggattattgaatgttgcacaccaatgggcgatagcgttcaaaccaatgttggactctaaagcggaagtgatccaccagccgatatgttgcttttccgcttccataatccattcatcccctccgcatattcctccgtggagagatggtttaatgatgatatattgcggacggatggttgccagcagtttctttttttcttccagcgtgttgcatcctatcagctcttcatccaatgctatcggcaacggagattcagaagtgagccgggccatttcctcccattgtccggcacggatcggctgttcgatagaatgtaaatcaaattctgacagacgtttcagtttttccattgcatcacccggagagaaagcaccgtttgcatctacacgcaactctatttctttagaagagaaatgggtacgaatatgacgtaacaacgccaattctttttcaaaatcgatagcaccaatctttagtttgacacaacggaatccggcttccatctttttctcgatttgggataacatgtgatcaaaatctcccatccagatcaggccgttgattggaatccctacctctccacgtgaaaaagccgtatcggataaagcccaactccctgcaaagaaatgccagatagccgtttccaaaccaaataagatggaaggatattggcataaaacatccttatcccacattccttgttctttctctacttgccgacaaattctttttaatatatcttcataatcagggagatcatcacaacttaaagcgggcaaaggcgcgcactctccaattcccactctacccggaaagtcaggagaagtaaagtgaagataccagacttttcgggtagtatatattccccgggaagttcccgcgggttgcttgaaatgaagcaaccggggaataatatctatcttacaatccataatgaatatcttttcaatctgctaattactgcacaatcagtctttcattagcctatcatttttaagggaatttcggatattgtttgaagttcggtttacgtttctccaagaacgcattcttgccttcctgtgcttcatccgtcaggtaataaagtaatgttgcgtcacctgccaactcctgaatacctgcctgaccatccagttcggcattcaatcccgctttaatcatgcgcaaagccaacggactaagcaacatcatttcttccgcccactgcacgtattcatcttccagttgttccaaaggtactaccttattcaccaatcccatatccaatgcttcctgtgcattatacttccggcaaaggaaccaaatttcacgtgctttcttctgccctaccacgcgtgccagataagatgcaccgaatccggcatcaaagctacccacgcgaggacctgtctgaccgaaaatggcattttccgaagcaatggataaatcacatactacatggagcacatgtccgccaccaatggcaaagccgttcacggcagcaatcacaggtttcggaatactacgaatttgcttttgtacatccaatacgctcaaacgaggcacaccgtctttcccgatatatccgccacgtcctttcacattctggtcgcctcccgaacagaatgccttatcaccggctccggtaattacaatcacatcaatatccgcttcttcacggcaaatgcgcaatgcatcactcatttcggcagtggtagtcggggtaaatgcattccgataacgttcacggttgatcgtgatacgggcaattccattataataatcaaaaagaatatcgtcgtattctctgatggttgtccactctctttgtgttggcataatttatttttgttttaattgatgataataattcttcaacatacgtgcatccttgtttttgttggtaaacacttccagaagcacaggttgttccatagtttccggctgggtgaaagttttcattgcttcagtcagctcttcatcattttgcgcttgtagataaaggaagccacgttcctctgcccagcctttagctgacgttttatggactgctgcaataaatttatgtgaggtgcccgacatatccaatcccggtaaagtatggaaaatctctcctcctccgttatttaataaaaggatacgcaggttggaacggacgttgatattccacaacgcattcatatcatagaagaaacttagatctccgatagctatgaaattcagtttgtcggaagctgccgcataaccgacagcggtagacaacgacccttcaataccactcgttccccgattgcaacaaacttcaatcgtggaagggatcgaatatagttgtgcataacgaactaccgaactgtttgccagatgcaatgcgcaggactccggcaaagctttcaataatgtaccgacagccaacatttccgaataagcaaactccggttcgggaataatcttacaataattctcccatacacggggatagtcaggagtccggttatccagcaggctggcgatcttctccagaaactcgaacgggtccatttcgatcaccgtagttaatgagccgtacaaatcaaccacctcaccgtccggcgatacgtgccaatgttctttaggcggatgctgacggagaaacttcttcaatcgtttggaaaccacatgtcctccgtaagtaatcagcaattcgggcaccatctggtctatcttctcttcgggcatggcataaagtgccgcatcgaaattctttaccggaataccgggaactgtctgattgccgatatgttccgtcaaccaggcaaaatgtttatataataacttgatatatcttttttcaaacaggtagataaggttcatctggccgatgataatcatgcgcttctgatatttattcatccggtcgaccagatcattataatcacggtcatagacgttcaatccctgataacgggttatcacacgtacttccgggagtgcatctaccgtgaattgaaacagcggttcggaaataggaacattgatatgcaccggcccttttccatgatgattcgtctccagcaaagcttcattcaccaggcgattacaataccattcatcttcttccgtatgaatctccggaagattgaccgacttctttaccagcgtttgaaacacacccggttgcggcactgtctgtccatccatctgtccgatccaggcagcgggacggtctgctgaaatgacaactaaaggaacattctgataaaatgcttccgctacagccggatgaagatttaataatgcagtaccggaagtgcagcacacagcagcgggcttaccaccattcaacgcaagaccaatagcaaaataaccggcactccgttcatccgtcactgcataacaggtgaagttcggatgattagacaaagtatgtacgatgggcgtattacgactacccggacacaacacaaccttagtaatcccgtgcgcctcgagcaacgcaaccaactggagtatgttcttcttgtctgtatacatgatgataattattagtagtttatgattttaaaggaggcgttgcaatcagccgtttgatggtttgcaacttcttttccgtttccagccattcgtcattcaattccgaagaagccagtagtccaccgccggcataaagagtcagttgttcatctttaatatgcatacagcgcagattcacatagatgtcagttcgcccttccgggtccagccaaccgataaaaccggaataataacggcggtcgtaaccttcgttctgcaatataaaccgataggcttcttctttcggtaaaccgcatacagcaggcgttggatgcaacactttcaagagatctcccaaacctttgttatctttcaaagaaaaccggaaatctgttttcaaatgtgacaaagcacctgcataagccggataaggcccgttctccgtagaatgaatgcccaacgataggagttggcgacgaatataagaagcgacataatcctgctctttccggttcttttcatcccacacttgcggcagtctgccatcttgtaaaggctgcgttccggctaacgcaaccgtatgccattcgtctttttcacctgataaaatgatttcaggagtgcttcccagccagatacccgtctgcggagtgtagcacaagtatatatatgaatgaatataacgcctgcacgctgcacgaaatatagacaaaggagaaaaaccggatactttatcaatagtaagatgacgtgaaagtactaatttatcaaaagtattatcacgcaaagcatttataaaggtatgaaagcaggaggcatattcctccgtagaagaagtcaggaacgattcttgtccttgcatccgcaaagcgacttcccgttcttctgccgtatcattgtcaatcggcaaaggttgcccccactgatcgggttgaatcaatacgacaggacacgtctcactcacctgaaacggagcaattacaaatcctctctgtccattcagttctttcaaatcgtatatcaaacggaccgctccttccgcctgtgtcaacagacggggaactttctccccgggaatgcggtaaacagcaaacggctgcttccgctgaataaatgcatcaatagttgtcaaattacttatttcttcgtcggtcatctctttttcatcacactgttgactacccgtatggaagacactagtttgtttgttgaagtaaacacgtctacattccatacatgggaggaacgtcccttatgtacaactgttcctactgcacgcactgtatctccttcatgtgcagaagatatgtggtttccactgacctgcattcctactacaatctcgtccggctggcaaagaatcattgaaccgagtccggcaactgtttccgccaatgcaagagtagccccgccatgcaaaatgccaaaaggctgacgggtacgatggtctaccggcattgttgcttccacacggtcttcgtcggcataggtatattgaattcccaagtttcccatcaatgcgtggcgtgcctgcgcattcagttggtcaaggggaatttcggctgcacgcacttcggatatgatagccttctccactgcaacggccactccgtcttcctcattcgaagcagtcacataatcggcacaggctttcaccgagtcttgtgaatgtcccatagctatgcccagccccgccaattgaatcattgttacgtcacacacaccgtcgcccacagcaatcacttcctcacgcttcatacctagcacctccagcaaagcacccaaagaattggctttgtcgatggcgcagggaactacttccagaaaatagggctccgaacggaatacgtccaacgccccattcagtcgtctcttccagtgatcttccaaaccaagcaatgcttcttcgtcatcgctcaccagcatacacttacaaggagcaaaatcaacggcagcagaaaattcttcttctttgattatttgcaggtcattcaaccgggcttcattttggatatgttcattttcaggagaatccgttatgatcgtatcatcatgataagtgaataaagcaaaaccgtttttacgggctttcttttccagatacggcaacatttcgggattaatccgacgttcaaacagaatttctccgttttgtgcattgataatctgacagccattataggaaaggataaaacctccatagtttccaagttcgagcatcttggccagcggcatcaggccataagtcggtctgccggacgccagcacaatacgtactcccatttgctgaaccttcaacagggcagccaatgtacgtttactaatttctttcgcatcattgaggagtgttccgtctacatcaagaaccaataatttatacttcatgattacacgattttgatttagattacaaaggtaggaaattgagtgaacgacagaaagcgtaaacagataaaattactttaatttcactctctcaaacgcatttccagataatcgcgaagaattcgggcgtgattatacaccggttcttttgaagcataaagtagtgttatcaccggatgtggtttgataagagtcagaaaatcagccattgatggagaagcatccagctctttttgatactgcgtgacaaaatctccccaatgtccgggaatatcttcatgaaaccatttacgtaatgtaggggatggtgttatgtcttttgcccaataatcgtatttcaaccattctttcttcattccgcgtggccataatttatctaccaacacccggtatccatctgtttctgaaaaatcttcgtaaaccctctttatccttacctgtatcatttccattaatatttagttatcaatagataaaccgggaaaaacgaaaattgtttagtagaactatttaattcctcaatgtgtcctgcgcttttttaaattcataaggagtcattcccgtctttttcttaaaaaggttatataatatcggggcactattaaatccggattcatcagcgatggcacgtatggtatagttaggatattttttcattagcttgatcgcataattaatgcgcagtccgttgatgtacccattgaaattagttccggtgcattctcttatcatccgggcaaagcgtgcattattcagatgtacaatctgcgccaaatcttctcttgagagctctggagaaagatatagctgtttttgaacgactgtatgatttaattcctggaatattttcttgttctcttcttcttccccactttctttgtctgtttcgtccaaaagttcatcctgttcttcaggagaaatcaattccggttccaattctgatgaaacctcctgttcctcgtacacttccaataactgattaccatcttttttattggcaaatttctcgtttatcagtttggcaagcatcctgtttttatactcgattatatggttgaaacgccacaaacgccaaagtataaacagggtcagcactacaatacacgccaaaaagcagagtgaaacattccttatttttagctgtgaggcttgctcggcgatgtattcttctttttcggaagcaccgtacatcgcgttcaattctaatgcagcatttttcctgtcggtactgttaatgctatccgttattgcaatgatggtttcacgtatttctgcggcttctttataacgattcagccccagatatgcctggacttccttattaagtatagttaaatattgagcgttcaaggtatcccgctgtgttctcaacaattctttaaagtccttacagttgtctattactgtctcatattgtttggaaagaatcaaataaggaatcgaatacatcttgccatccggagtatgagattcttttattgccagatatttttgataatatccttctgcttgcgtatatttcttttctaaataagaaatataggccaattttgcatataaatagctatattgaccatcaatgtagccttcgggaacctccggtactttctctaattttttaagaagtttttcacgttcataagcaagagccaaagcttcatcaatacgggaatctgtcattaaaaatcccatctctgctccataataataggaaagcagcatcatttctctcatatcctttgacccacgcagtaattcaatcgtacgaccaaaataattatacgcctcatctttcaatgacagcctccaattattctctcctatgcaaaaaagcaatctagcttccgcctctctgtccttcagtttttgagcctgcataattccactaagagcataatgcatgctctcattatatttactcattatggatgaaagttcagctaaataaaccgtcatcttcaacatgtgcttaggttctctttgagagatggaatcaagcaagtacgacttccttgcatacataaaagctagtttattcatatacatattacgatatgacaaactgcgcaattcattaatcagacgcagagggaaggcttttctggtttcggcctcatccaacaactgtaaagcacgtttggggttggaaatataaatatctctgatatatttttctgtatacaaagagtcattatttataattttatcagcccttgaaaattgattgtgtacaaatagaagcacaaaaatacatacccaaaaacgcataaaactcttaatcgtgtttaatcattaattatccaaaggtatgtattttccaaaaaatgtgcagacacaatttaaatttgcaaaataaaaataagaaacattagctaaacatatcagagacgtaacatggttccaagtcagctattctcctgaatcacagtccaacgctttgctcaatcgcccttcaaggcatacacttaagtcagtcgttacaaacttgccattataaaaaagagtaaatatggtagccggagtaggtgcattttgcgcctgttccatactttccaattcaattattctcaatggaatgtctttgctcttagcagcactgaccaaagaaccgcgaacgtgaaactccgtaaacgggcagcgatgggtataataaacgactattccatccttatccggacactcaccgctcaacacgcaatcattaaaagaaggatcaggagcagccgggtttagtttcaaacttaaaaggctgaatccgtaagggagtttttctattgtttggaaaccttgtcgcaacagccatttcgtgtcactcataaaatgaaatttagaagtgcccaccactgtgacaagcccatctttcccctgcaattttgcatcatcaatggcagactgcaataatgccttaccatgtccgcaacctttatatttacctgacacccagaaacagtttatcatcagataattgggagcattcaccggaacccatgctttttcagcaggaccgtattcgataaacacttttgcccgttcatcaatacgtctgaacacatagccgttatcgaactctttcttcagccattcttttttgagttcataactatccttgcatttcttatctgaaaaagcacagcatatatgttcgtttgcaatattctcctttgtcaaagtgatgtaattggtttccatcatattctatttaattaataggttaaacaaataacagttcgatattcactcattgttatgagttggtagcaaatcgccaagctaatatcctgctacttttagttccctgctgcattcgaataactttatattcggacacattcaccgattttaatttggtatataacttttccagatttttttctttagaaaccaaactcgtaaaccatccgcagttcttctgatatttttggctctcggaaatcatattcaataagaaacgaacttctccgccctcgcaccaaagttcattcgcactcccgccgaaatttagctgcactttatttatcttcgtacctttcagactgcttaatttgcgtaacgttccgtcttccgcctcttcacgcgaactatgaaacggaggattgcatattgtcacatcaaaatactcatcaggcataataattccatcgaaaatcttcttactatctttctgaagtcgcaagtcaatcttatgagccaacacagggttgcaagtcactatctttcgtgcattttctatcgaaaccggatcaatatcagtaccaacgaaggtccatccatattcagtgtgtcctatgatcggataaatgcaatttgcacctaccccaatatccagacatctacatttagacttctgtccattagcatctcctgccggtaaatccggtgttgttccgttcggctggataagatcggcaatataatgaatgtaatccgcccttccgggaataggcggacacaaatattgcttcggtatgtcccaataccggatgccataataagttaccaataatgctttgttcaaagccttcaccgcttgcggattaaaaaagtttatagtttgtattccgaggggattgagcgatacgaatctctttaatggaggataattttccatcaacaatggaaaatcatactgaccattgtgcttatttcttatatgtaactcacctttttttgccatgcgggcaaagatacagagaattttcctgcctacaaattcttcttaactcttatcctaacactcttctgaatatcatatataatattctatcatttcaatcagcccggcgcgtaaagtatacttagttgcttcatatacattattcacacccaacttccggaaaatattctttttatgggtgataatagtatgaatgcttgaggttctttccaatgctatttctttcacagatttcccatgtgctatcaatttaagaatgtcaatctccgtaacagtcaaaacagaatgaatttccggtttgtcggaaccgattatcaataaattggttatctgatgacaaagaaatcgctccccgtgtgctgtacacatcaatgcagaatgaatttcctcaccggagttctctttcaaaatcataccaatattccttgctatactcatcctacgaataaagtcttcgctcaattcattggaaaacaatatccaacgaactctcggaaaacgtttttctataataagaaactcttctataccattgatgtcaaacagtgtatagtcaagtataacgacactgtcattacattctaccaatgcaagcatgagctctttcttgtctgtcacatctatcatgcgacatccactgaatatagcggaaatatatccatgcattcccattctggttatatcctgattatctgctatgataaatgtaatgtcagtgttcattgttattctgatttttaaattcaacggatatttttcaaacgcatattgcagcccggagacacggaggtatcatcgttctttattagctacatcaaaccacaaacgggtagtaatctcatctgctccctgatgggatatggcaatctgatactgcttaccattcagtgattgttccgttacgggataaaaaaagcgacgaggtaactctccggaacccaaaacggaatcgggaccagggataagctggggataaccgagcctgcgccagtcagtgaaagcatcgggtccctgtccataataagcgatccacttctgccagccgatagattcataccaatgtgcggcgtcgaaccgaatcgcctcctgctgtaaataggaatcgattatatgattgtctataatgccaaactgattcaatgaagcagtaatagcttcgcggtagagcgtttccgcatcagccgttatccagccgcgtgcagcggattctgcaaagataaacaagacctcggcatacgtataaaatacagccggagagctatctttcaaaaaataagtaccgggacgggaaactttattaaatccctgattattagcggcatcagcagataaggaattggcagctcctacatagtttttcacactttcgtcttgaggtagctgggctaaaattccaattctcggatcattccattcattcagtttatcaatcaacgtttttgatacccgctgatcatcacgtgaattgaaagcagatgcccatggattccattgtggtgaagaagtaaaaacaaaacgggctatagcatcattgctatctattacactgttacgattatcccaaagggaagcaataacccgacgcgctgtatcctcatcccggtcagctaattcaagggcgatacgtagccgtagggagtgggccaattgtttccagcgggtaatatcatttccgtaaatcaaatccccttctaccgttcctcctgtggtagaaagcaactggtcagcagcgatcaactcctccaaaagcccgcgcaaaacagtctcttgtgaatcataagcgggtgttacactttgtgcatattcactgtatggtatatttccatacagattggtcagcaacaggtaaacccacgaacgccacactgtagctatccctcgataattatcatttccgagttccgaactgataatagcattcaagtcagttattagcgttgcatagccggtgtcccacgtagtggtaaagctaccattatccacattatagcaatctggctctgtatattgtattttagcccaatgttgcacccacaacagagtcgaattatagttcgtactacttccccaataaagattggcggcatgatactgtgcagcggcaagtaaataagccggctgtggattttcagtggcattggggttgcggttgatatcagtcaattcatcatcacacgatgatagggaaatggcaaccacttgtacccatattatatataaaaaatatattcttcttttcatcttatcctattatttaaaggttcacatttagaatttcacggaaaggttcacaccaaaggaacgtgttgtaggcaatgaataggcttctactccttgtgcatttccagtagtcaaagccgattccggatctatattagggacgctcttataaatagtccacaagttacgtcccgtcagtgtaacggaagcttcttgcaaatgcagtttctgcgtccacaagcgaggtagacggtaactcaaagcgacttctcgcagtttcacgtaagaagcatcatatacattagcttcagcaatactataaatacgatggtagtatttctcagcagatacaacctcttcgttcttagaaccactttccgtcactccttctaccataatgccatcctgatacacacgggtggattgcccattgacctgggcatagtaaagtccatcggaggatacggaataagaaggagattctgataatcgtacattgttacccatggcgtcagtataataccacaagccaccgtgctcggcatccctgcccgataatgtgttagctaatacaccggtatattttccagttttattagtgttggaaaaaatagaaccacctacacttgcatctatcagaaaagaaagacttaacgaacgataactgaaagtgttactgataccgcctgtccagtcgggcgtaaacttccccaacgttttattagtggtcgaaatcttaggcagaccgttagcatccaccacaacgtttccattagcatcacgcacgtatgaagtgccgaacagggttccataagcttcgcccactgaagccagtatctgaataccagacgagtagagctggtaactcgtaatcaaaccttcatcatccaatttgacaaccttgctgctgttggcaccataattcaaatccagattccaacgaaaccctttcgatgtttgtataggaacagcgcccaattgtatttcatagccacgattacggatatgtccggcattacgcacctgcgacgtgtacccactggcagcagtagtagctagtttcaatatttgattacgactatcggtcttatagtaagtgaaatccaagtataggcgattgtcccaaaaagccgcctcgaaaccagcttctatagatgacgtattctccggttttagattcgaattcataccaatggtagaagaactttgaagtggattcccattgaaagctgtttctgaagtaaagaccgttgccaattgataaggattggcatctgctcccacttgagaccatcctccacgtatttttaggtagttaacagctttacttctccacccgaaagcttcagaaagcaacacactagccgtcaccgaaggatagaaataagaattgttgtccacaggtagtgtagacgaccaatcgttccgtcctgttatattcaagaaagcccaacgacggtaatccagttgtatggaaccgtaaaggccatattgccgtaaacggtagaaatcattggacgaagtgagcggatcacgcgagttagtcaatgtataaagatcagcaaccgccaaacggggagcagcctgataattattctcatattgtttgttacgtacattaaaacccagaagagcgtcaattccccaatttttattcaactgtttgatataagtcgccaatacttctgtgttattctctttcaccgtataggcatcttcagcataactgccgtaaggcgaaccggcacctgcactcccccattttactttggatttcctccggtcattataccagtcggtactagtacggaaacgcacatgcaacccatctgtcagacggaattcggcatgcagatcacctatcagacgatgacgttcctgactctgtgtattataagaagcactccaaaaaggattgtcgtaatagcttgaattccagttgcgagtatagtccgccttcaatgagttcgtatccacttgacgtccgaaccacaagaactgaagcataggactgttagaacgtacgttactgcccgagggggtagctgaccccggtaaactgggagctgtataaacgatgtaattggccgtagctcccaccacaatccattttgccagatggtaatccgtatttaagctgatattcgtcttattagttccagcatcaggaacgatactgacttgtttttcgtagttatatcctacacggaactggtatttgtcgtctccacgggcaatagaaataccgttgtttgtagaaatacccatgcgaaaataatcgcgtacattgttgggatgggatacccaaggagtagccacacgattaccgtcagcgtccaatgggctatcgaactgaggaatcaacaaaccaatatcaagacgtggcccccagctttcgtctaccccgtcattcacacctgcacccttgccatctacataactgaaccgtccccctgccccttgtccaaaaagattttgaaactccggcaaggtagcaacaaaagagacttgcgtggaagaatgtaatgtaatccctatccctttctgccttttgtctcctcccttagtagtgatgacaatagcaccgtgagcagcacgcgcaccataaagggcagcggcattcggacctttcaatacagtaagtgtttttatgtcttccggattcaggtctgctattgcatttttaaaatcacgtccgctggaacgtgcattaagctgcgaattatccactgggattccatccacaataaaaagcggttgattctcacctgcaatagaagtttcaccacgaataacaatgcgactggaaccaacatctccttgtgtattggtaatacgcacaccggctatcttaccactcaacgaatttaacagattattatctttcccttgcaccaaagcatcctgttttacttcctgtgccgtatagcccaatgcctttttctcgcgtgaaatacccaaagccgttactactacctcatccagcagatgcgtatcactcttcagtgttaccgatacctgtggtgcaatagctacctcttttgccatcagactaatgtaagagattagcagccgggtggctgatggcgagagtccactcagttcaaatctcccgttgacatcagttacggtacccaatgcagttccttttactataactgaggcaccgataaccggctccccatcttcttctgtggtgacgatgccccgcactgttgtcacctgtgctgccccttgtatcactcctattgcaagagcaagcaaaaataaatgaatccttttacccattattgtttactgttaaaatgatggggcaaaggtattagatatatacaaactgataaatcccgtatgaatggcattttatataccatatttgcggtatatttacagtttcgtatatgacttttggatttttgcttctaatcctttttattatccaaagcctgtctgacatcgtcaaacagatcatccacatcctccaaaccaattgagaaacggatagtcgtatccaacacatccatgtcctgtcgctgtttatcagtaaacggtccaaaaatagtacttgcaggatgaatagcaagcgtcttattgtcaaacaagttagtagcgcgacgtatcaatttcagtcggttgatgaaagcaaagcatgcctctttactttccaggtctatcgtaatcatagcaccggcagtcggaccaaactgtctttgtgccaaagcatagtatggattatccttcagccccacataattcacacgtttgacagcagataatatgcgaagcttaccagccaacatagcggcattggcagactgtatccgatatcgcgcgtccaatgtttccaatccgatagtatgcatataggccacatgaggagtcatataagctcccagattgagtaacatctctgtacgcatacgtttaccgaatcccggacatgtaccataatcaattactaaaccaccaatggaagtggctccccctgataaatatttggtactggaaaccacttcaatatctacccctaagctatgtgaatcgaattctgtgaaaggaataagcgtagtatcaacgatgagaggaattcccctttcatgaactatccgtgagagcgcctgtaaatccgccacttccatctgcggattggtgataatctccatataaatgcagcaggtattactgtctactgctttctctactgctccaatgtctgtcaaatcacacaatctaggttccaccccgaagcgggacaatgtaccagcaataaacgaataagtattaccaaacaaatgacgcgatgtaactatattctttcctgcagctgcaattgaaaataatgtattactaatagccgccataccggaattgagggctatgacttctgctgcccccgtaagttccttcaccttattctcaaaaaaagtcactgtgggattcatcactctggagtaatccggagcatctgtccgcccgcaaaaagcatcagccatgtcatcggcattgtcaaattcataagccgctgtatggtaaaccggcatactgatagaattgtaagcatctcttctttggaactgcgtatgaatcgcttgggtctgttttttcatcattctattcattaatattataactatcaaatctcgtacaataagaacaaaggtagatataaaaactgaaatctgacagtagataaaaacagatatttaactgataataagcattttggaataatattctttaaaccgataaattcaatctaaaaaaagagtgtttattctaaaataaacagttcaaatagtgttattttctatttcaacagaaaccgcccctttttatgcttatcttattcacatacacaaaataaaaaatccccgtaaagtactactttacagggatttatctattaattgaagcggagagacagggattcgaaccccgggtacctcgcggtacaacggttttcaagaccgccgcaatcgaccactctgccacctctccaaaactcctttatcagaagtgctttccgttgaaagcggtgcaaaggtacgaatcatttttaaatctgcaaacattctgatatttttttcgcgaattaatcgtatttttgcagttcattagtaagaacagaaatatgatataccctcaaaactttgagcaaaagataggattcgaccagataagacagttactaaaagataagtgcctcagtactttaggtgaagaaagagttacagacatgaacttttccgagcaacatgaagaggttgaggagaaattaaaccaagtaacagagtttgtccgcatcatccaggaagaggacggatttcccgatcaatttttctttgatgttcgtccttcgctaaaacgtgtgcggatagaaggaatgtatttggacgaacaagaattatttgacctacgccgttcattagaaaccatccgtgacattgtacgctttctacatcggaatgaagatgaagaagaaaacaataccccctaccccagcctgaaacgactggcaggagatattgccgtgttcccgcaactgatagggaaaatagatggcatccttaacaaatatggaaaaatcaaggataatgcctctaccgaattagcccgcatacgtcgcgaacttgccagtacgatgggaaatatttcccgttcattaaacagcatcctgcgtagcgcgcagtccgaaggatacgtggacaaagatgtagctcccaccatgcgtgacggacgtctggtgattccagttgcccccggactcaagcgaaaaatcaaaggtatcgtacacgatgaatctgccagcggaaaaactgtgtttatagaaccggcggaagtggtagaagccaacaaccgcatccgtgaactcgaaggtgatgaacgacgtgagatcattcgcatccttaccgagttctcgaatatccttcgtccatctattccggaaattcttcaatcatacgaatttctggcagagatagattttatccgtgcgaaaagttacttcgccatacagaccaatagtctgaaacccaccgtagagaatgagcaactactagattggacaatggcagtgcatcctttattacaactttcattagccaaacatggaaagaaagtcgtaccactggatatagagctcgatcaaaaacaacgtatccttattatatccggaccgaatgccggaggtaagtccgtctgtttgaaaacagtcggcttactgcaatatatgctgcaatgcggcatgctgattcccttgcacgaacgtagtcatgccggtatattcagtagcatctttatcgatattggtgatgagcaatctattgaagatgatttgagtacctactcttctcacttgaccaatatgaaaatcatgatgaagagctgtaacgaacggagcctcatcctgattgacgaattcggtggaggtacggagccgcaaatcggaggtgctattgccgaagctgtactgaaacgtttcaaccagaaaggaacatttggagtcatcactacccactaccagaatctgaaacattttgccgaagatcatgaaggagtagtgaacggagccatgctttacgaccgtcatctcatgcaagcacttttccaattacaaatcggtaatccgggaagttcgttcgccgtagaaattgcacgaaaaatcggactaccggaagatgtcatcgcagatgcttcggaaatcgtaggaagcgaatatatcaatgcagacaaataccttcaggacattgtacgcgacaagcgttactgggaagggaaacgtcaaaccatccgtcaacgggaaaagcacatggaagaaaccattgcccgttaccagacagagatggaagaattgcaaaaatcccggaaagagattatccggcaagcaaaagaagaagcggaacgcatgcttcaggaatccaatgcccgcattgaaaatacgattcgtacgataaaggaagcgcaagccgaaaaggaaaagacacgccaggcacgtcaggaactgacagacttccgtacttctctggatgcactggcatctaaagagcatgaagagaagattgcacaaaaaatggagaaactaaaggagaagcaagaacggaagaaaaacaagaagagcgaaccgaaagctgcagtctcttctccctcaagtgcccctaaaatagtgccgattgcagtaggagaaaatgtaaaaatcaaaggacagacaagcgtcggccaagtgatggaaatcagtggtaaaaatgcgactgttgcttttggaagcataaaaacgaccgtaaaaatagaccgtctggaacgtgccaatcatacgcccaagacggaagggattgcaaaaagcacctttgtcagcagccagacacacgatcagatgtatgaaaagaagcttagcttcaaacaggacattgatgtacgcggaatgcgtggagatgaagccttacaggcagtcacctattttattgatgatgccatattagtcggcatggatcgtgtacgtatccttcacggcacaggaacgggaatacttcgtacacttatccgccaatatctggccaccgtaccgggagtcagccactatgccgacgaacatgtacagtttggcggtgccggaatcacagtagtcgattttgactaacacgtaaacaaaacgttcaaagaacttgttctcatttagaaaaccactacctttgttacagtggttttctaaaacgagaataaagcatgaagaataatctgttaagcgaaaagcttatttatacaggagaaagtcttactcctacccatttacatctttgtacttacaatgctaccgagatgcaggaaagctctagtgatacttttcaagccatcaaaggtacgctaaacaacgatcaaatcaactggctgcagatacatggaatgaaaaacacagaaactatccgggaaatttgcagtcatttcgaaatagacttccttgtcttacaagatatattgaatgcggatcatccgaccaagatagaagaacatgataaatacattgtcctgatcttaaagatattctatccgaacgaacataaagaagaaaatgaactggacgaactgctccaacagcaagtctgccttatcataggaaataattatgtactgactttcctcgaaaaagaaactgatttctttgatgatgtcagttctgccttgcgtaatgatgttctgaagatacgcagccgtcaaacagattatctacttagcgtactgctcaacagcgtgatgggaaactacatttcaaccatctcttccatcgatgacgcactcgaagatttggaagaagaattgctaaccatcaccagcggagacgacatcggtatccagattcaggcattacgacgccaatatatgctaatgaaaaaagcaattctccccttaaaagaacaatatataaagctactgagggcagaaaacctgctcatccataaagtgaaccgtgcttttttcaatgatgtaaacgaccacttgcaatttgtattacaaaccatcgaaatctgccgggaaacgctttcttcattagtcgatctttatatctccaacaatgatttgcgtatgaacgatatcatgaagaggctgaccatcgtatccactattttcatccctttgacatttctggttggagtatggggaatgaattacaaatggatgccagaactggaatggcagtacgggtatttatttgcctggattgtaatggcaattatcggtattattgtatatttgtacttcagaaaaaagaaatggtattaacaaaaacacatcattagtcatgaaatcaatcaaagagctatacaggataggtacaggaccttccagtagccacacaatgggaccacgcaaagctgccgaaatgtttctggaacgtcatccggatgctgcatcttttaaagtaaccctttacggcagtttagctgctacaggcaaaggacacatgacggatgtagccattatagataccttgcaacccaccgccccggtagaaattgtatggcaacccaaagtctttctaccgttccatcccaacggaatgacatttgcagctctggacagtaatgataaagtgcaggaaaactggactgtttatagtatcggaggcggtgcactagcagaaaacaatgataatccaaccattgaaagccctgatgtatacggtatggaaaacatgaccgaaatacttcaatggtgtgaagataccggaaaaagttattgggaatacgtgaaggaatgtgaggaagaagatatatgggattatctggctgaagtgtgggccaccatgaaagatgccattcaccgtggactggaagcggaaggagtacttcccggcccactcaaccttagacgaaaagcttctacctattatatacgtgctaccggatataaacaatccctccaatcaagaggacttgttttttcttatgctttggcagtaagtgaggaaaatgcttccggtggaaaaattgtgaccgctcctacctgtggttcctgcggagtgatgcctgccgtactatatcatctccagaaaagccgtgatttcagtgatatgcgcattctacgcgcgttagccactgccggattgtttggcaacattgtcaaattcaatgcatctatttccggagcagaagtaggttgccagggagaagtaggcgttgcctgcgcaatggcttcggctgccgctaatcaattattcggaggtagcccggcacagattgagtatgcagcagaaatgggattggaacaccatctgggaatgacttgcgacccggtatgcggattggtacaaattccctgcatcgaacgaaatgcatacgccgctgcacgtgcgctggatgctaatctttattcagctttcaccgatggtatgcaccgtgtctctttcgacaaagtagtacaagtaatgaaacaaaccggacacgaccttccatcactttacaaagaaacaagtgaaggaggattagccaaggattataaacaaatgtaattataaaaaacaacgggctatttctataaaaggaatagcccgttttgatttttatgattaaaaactattcagtcggcggccaatttgtatcgtctccattgctaatatctttttcatgtagcaatccgccttcctgtaagaaataaagcgcatagcgttggctaccttgcttcacctgaatcacagattccatcggattttgtgggaaagtcaacacatacacatccgtcactacccatgcattatacttggaatccatgaaagccgtataaacagccggtaccagctggtctatgctattcaattcattttctgtcatcacccaattggcattggcatcaaaccaaacctctagttcgtcattacttacccaacagtcagctacataataggcacctttcatctcccattctacattctgggcagccggatatacctgctttaaagcttctgtaatattactgggcggaacaaaagtatcatcatcgtcattatcacatgcgccaaacgaaagagcagtcatcatcaataccactgcccaagcgctaaacttaaatctccacatagctatcttcttgtttaggtctatttatcacaaatctttagttaatcatcagccttgataaactttcccttcttatcaaatttgaaagaaagtccggtagacaattctatttcatatcctttgcggtcacgttcgactttggtcactccttcgttcacaaaattatgagacttcaaataattgacagcaaatcctggaattatactaacaggaacaacctgtcctttctttgcacttacctcttcccagttgcccttactgtcaaaatcaatttccgtgccatccatcaataccacttcatacttggtagactccatcatatctttatcaatcttgatatgagcaatctgtggttttgcaaaattaccattaataaaattacgtgccggaagcggtaactgattcatgtctttggttatcacatcttttgcaaatgaaaactgtacggctacaatagccaacacaaataaaaatagaattttcttcataatcgttattcttttagcgttaatactatactttcgtttcatacagcaaataacgatacagattctggaaagatttaggaatcatgcgagtttgctcttttttttgtattctttaaccatctaaaaaaataatataccaacgatcctcacagacagttggtatatttcacatatagatacatatcagtttttaaaccaatatgagggctaagttagaaatataccgctgtacgatttctaacctgcaaaatgtagggatttcatgagtttatcatgaatctagggacctacatattcttttataattatagtttgtgattcattttaaatatcaacgatcttcacagacagttgatatagtgggaaattcacatcggctttaacctccgatgtcagggtgtaaattagaaatgtaccatcgtacgatttccaatttacaatgtaggagaatcatgccttttacagcatgaagctagggacctacatttttttcatctcacatacgaaacactcacgtgtttattacatctcaacattttattttataccatttcttcattttataaatactcattttagctaacaattcttataccatacctatatttatatctatttttcttttccagtcatatcatccacttgatttattttagctaaataaaaattttgtaacctcaatgcctcatttgaagagtcaaatccgttttttattacttctgcaacataacttctacgcttatgtatatgaccattaaccacctttactattttattagcccatatattgggagtttcttctaacccaatgtaatatgcaagttctgatgctgttgtctcctcagttatattctttgaaaaaaagataggaagtcctgaacattgcgcctctattccaacaacaggcatcccctcatataaactaggcaacaagaaagcgtcaaaagcattataaaattgctttatatcatctctacgccctaaatcgataaccttgtcagtaactccataactctcaattctatcatgcatctcattctctaattctccaaatccaatcataacaagaattgcattttcctgtttctttgcaatctcattaaaaatatctattagaaaaagtggattcttctgtggaacatatcgaccaataaaaccatatactattttattttcccatccaaactcttttcgggtatcttctctaagcttcgcattaaaagcattggcatttgcatcaatcactgttttaaaaatattcacctttcctctatcataagttttcttgccaaactgccaaattccacaatcaattgagttagccatataacaatttgtaaaccaatgggaaaaaggtcgtaagatatatttaatcagcgttttcttttcattcttatctcctttagatatactttcggatatcctcactttaactccggcaacacaacctaaaaacataggaaaaagattgagagtattatcaaaagcatgcatcacttcatactgattctttttaagtattttgtatgtttcttttagatggggaataatatccttgtaaggtgctactttatacactcgtcctcccaaagacctaatttcctcctcggggataccattagaatcagagtcacaaataaagtcaaattggacttttgtacgatcaatatgacgataatactccataatcaaattacgtttaccaccagagtgtaatacgccagctattacagcaattctttgcatactattatttctttatagattcgttataaaatgaagaaataccatccaacattggtgtcaaaatcacatctacggtccgcttcattttctctacatctaaaaccatattagaaacatctacagggcgtgcatttttatattcaatcttaaaatccacttttgaaattattttcaagaaagcaagcacatcatttacagagtaccctctaccacttcctaaattaattgtctcattacaaatatccttatttatcaattggtaaaaaacgctagcgagatcttctatataaatgtagtcacgaatagcagaaccatctccccatacttccaccgatttattctctataatcttaccaatagccactgccaccaatccttgttttccatacagattctgtccatgtccatagggattagatggtctaataatgagatattttagattttgagttctatttttaaaaagaatactgttttccatcatttgtttcgaccaaccataataggatataggctccatattatcagtttctacaaatggttgaaaagttgtcctattaccataaattgtccctcctgaagaaaaatagacaaacttaattttttcattagcacaaaactccatcaactcaatcgagggaaatatcacattcttaaattcattaacataatcatcatagttacttcctggaatcaatgttgatactaaatgcactacaacttctatgttattggccaaaagaatattctttacttcatttatattactcaaagaatttctaaaaacagttaggtcataaccgttcagtctggatatattggcaaactccggttctagaatgaaaaccaaatattttctatcagaaacaaaacgtttcaccaaactggaacctataaagcctgctccaccaataaataatatattcataaaactcttttttttagatgcccataatccatacgaagatattgtcgcatgtatatattacatacatataaataaagcactcaatttagtaagcgtcccaaacatggtatacccctttcaggcgagtgccagtaggcactcgtcccttgtcttgaatcttaatttttaaatcgtttcactaattcgttagacatattttcatgggaagcaggttattataatgcgttcgtcccttccgtatctccgtcatatacttgcagaagaaagatcgaaagctgattcccgcctgtttgcagatctcaacaaaggtatcataaactgccgatcttaaagcacctttcgtactacagaaaaacagactgtttaaccttcttttggtcttttgatatgaaaatataaacatccccttgaagaggatcacggtggtgacgagaacgaatgatttcagaaacacaagaagccttgtaccgcatatcgtgaaaactaagaagataatagaaattcttcaaaccggaaatcgtcaacataagcctccagtttctctaccaaaatcttcaaaccacggtagtccaaattgcctttacggatattcagaccattacgagtctgaatggtgaccaggatattacctgagtttatctcaagattagactgcatcaaagccgactcaacacaaactgaagccaagaatgcttccaaagcggaatcagaagaaggaataacttcaatctgaaccggaacgattttcttacgagtcttcacaaaccaactattaaaataacgataaagaacaccgtgaatcaagcaaaaagtattgatcgaaattccttggggttcaccttcagtcttgtagaggaaccatagcttttcaaaatcactgctgctgtacataaaattattttttaagtacgcccagcaaaggtaaagaacaaatagaaacaggacaagacatcattttcggatgcttacgatttacaacgaaggtatgctttctaatttatagccctaatttgagtgtttatccttagtgttaagatattgcaaagcatttcaacttatcacttatcattttgcaactactttcccaatcaaaacgggcaacatttataaatcccttccttatatattcatttctcatattttcttctttcaccaaagtaaccatactttttgccatcccctgaatgtcagtaggctcacataggattgcactatctaacaacacttctggtagcgaacttgtattagaggaaataaccgggcaaccacaggcttgggcctctaatacaggaataccaaatccctcataaaatgacggaaagataaaagcgcatgcattactgtataacttgactaactgaacatcagaaactcgtcctagaaatttaatacgactctctttcttatacaaagataaatccatatcattgaaacttctactttttgtttcaccaatcacatacatttttaattcaggtactctctcagacagcagcaaaaaagaatccagcgctgcaagaaaatttttattatcttttacagaagacactaccaataaatatttatcactaactaaattctcatcacgagtgggatgaaaattatcactaactgcattatatattacagatattttatttaaaggcagattgtaatagcctgcaatttctttttttgaaaactcactaaccgtaaacaagtgttttgatgtccttataacttgtggaattaacaacttatacaataagcgaaatttaaaagaaaaagtccgtgggtagcgaataaaagtaatatcatgcaaagttgtcaccttattattatacatcaccggaccagtattaccccaattaataagcagaggtttacctactctattaagatagttaggcaaatcccactgttcccaaaaatgccctatatgagttccaacctttattactgataactcctcagctatgtcttcttgaattatattttgaggagccacgaaactaatttcactcccaaaaattctctttaaccgaatggacaattctatagaaaagcgttgtacaccagttacctgttgagtaagaaaacgtgcattaactacaatcatatgtatatttaaaatgaagtattactgataaataaatccacatccacataataggaaaagaaaaatcagggatagccacgcattgagccacaaacagaactaatccaaatattacaatacttgcatattttttagaatccttatctagaattggtttcactaatgcccaaataaagtagaagaagagaaaaaaaccaataaatcctacagcagacattagatttgtcaaaaagctaaaacatcgatgacttcctaatccaacacctataaaataagtatcagttatcatacctattgtataggtaactgcacccattcgtgctaacccagagatagaatcacttttagacaataccatttcgcctataagagtatcatagctcattaaatacgctaacaaatataaaagaaaacatcctaaaagacatggaattctcattttagaactgaataggacacaaaacactcctgttatcataaaagccataatagctgttcctgacatattcaacaccaaggctaataaaacaaaaaaaagaagttttttcaattttccatagtagataagtgcccatgatgacgatgccaagaaagcaccagcatatgatggttcagcaaaagtcgcatttaaacgtaagccttgcagccaatattgagcataaccttcattactataaaaaaaactatcaggaaaataataggtaccagacactttagctataaactcccaaaatccaataaataagactatttttatagtagtcaaaaaaatactaacgatttgatcttttgttattttatgctgtatattcgaaatgctacaaattgttaaagtatttataactaaatatgctatttgaatcatatttttgcttgaaaagctcaaccgccctaatatttcgccttgcgctaaatcattatcatttgtctctcctggaacaattaccccaacaccatcaaaaacaaaaggcattacaaatgataagattacagagtatacaacaaagaacaacaatattttaaagaaacgaggttgattttgcttcaaaaaagagccccctaaaaagacttttgtgataaaaaaaaaatccgcaactatataaggtggtataccactagtcccaacattaaaaactgcagcagcttgaaatacacaagagaaaatgacgacagagaataaatattttacaggcttaaaccacccgataaaacagatagaaacaaaaaataaaccaaacaacgtcattactctctacttattatcaagcttaatactttgatcatacaaatatgacttcaaaaacatcttatccaaaacatattgtatcattttttttatatcaaacaatattttttgagacctacgaacatatttatcttgcggtacataatttctccattctgtaatatacaaatatttataatacaaatccctataaggatggtcacattcttttatccatggtttaagttttcctgtaaaatgtataattgaaggagctatctgtgcttctcttagttccttcttatacctaaaatgaatcaaaggtcttcgaaataagaaacactccataacattccattttatcggcaaaaaaagtttctgatcatataataatacatttaaaatatcttggtcatgatatacgatctcttttaaatgttgttcaatatacacaaatgcatttttagtaaattgaatatctctcataagtgaaagattcatcaacattactccagcattaaagtatgaactttgtactggatatcccaagcgtcttggagcctcagaagaaattacaatattatcttctacagcaccaatagtataatactttaaatcaatattccacaatgattctattctaccatttacaataatatcacagtctaaataaagtatcttatccaatgttactggtaaaacttctggtaacattaatcgataatatgttgctaatgaaatatgagaaaacttcccaccaaaaggcaacccttcaaatttttttttatcaatttgtatataatatagtctttgactataggcactaactaatgcaaaaagtctacttttatttacatcatctataaaatcagacactatataaatatcaaaacatatgttcttgttgttttcaaaaagagaagccaatagtactccacaatgctgcgaatagttgttatcaaatgtacaaactatactaatactttttacaaacggatccatctctcaggtattatataaggtgccttttctattttgggattaaaccagatcttaggagcaaccactatcttttgaggattattattaagccatgccccccaccaactataggtactatttgctataatattatgtttagcataactcattaattgcatatcgcgatagctttgtttaccagatacaggattccaatctaccagtttataatctatatctttcaaattctcttctacccattttggattatctgtaaacagataaaaaacaggattagaaacatgttcttttaaataattaatagcttgattgtaatattctacagaacaagtaccatcccaaatatttctttttagatagtcagctccttttcgaatatgaattgctactgaattttcatttttcattttttctgctaactgaatattttggtcatcttgaaaaggagtaaaaacaaaattacgccttacatccttctcgcaaaaattaaaatataattcagtttgccaaagaccacaaaaaatacaattactagtcgcttttttataaatcaattcatcataaataaaaggtcgttccattaaatacctattgtttggaaaaaatgcggacatacgtctgtatatccttgaaagcaaatctttcttataagctaaactaaacatattattaggagcattctttatttcaatatttggaaaaacttcttccaaagcaatatcctcaaaagaccactccggttgaaaagatgtttgatctaaaaatacatctaatccatgactcattaatccacgagaaaatgcatactgaaacatcttattcgccaatccagcagcaatatatactacaaccattatctattaagttttaaattgtacaaatccattgccgctcccattgcagcatccatattataatattcccactcagcaaaacgacctaacagatagacaccttcactttctaattttatttttaaggcttggatcatatcacgagtatcactatcttgtataggataagtatatttttcataatgatgagtcaaatattggggggaaaatggaattaattctaaattcttacatatattttcttccgaaataaaatctgtaaattcaacagttccagtcgtccttcccattgcattattattcagtgaaaaattaccagtgcaaataatccgatgagattcataagctttgtctggcaaataaatccagctatatggattcttatctatttcacaaaaaacagacgttgtaccatgaaattccaatttttcaatacgatcataaaagcttaaaatatcaaaacaatcagtctcggtcatagaaaaaatatacttcaaattagcacaaaaaataactctatcacattctattccatttacaaacaattttccatctttctttaagatattagaaacttttgtgttatattgaatttttatatttttcgctaaagtatctgccaaaaattgtgatccaccagtctgcggataataaaaagaactatgaacaaaatctcgttcttcaatatgcttcatattgttataaatcatctcttttaacgttggcattggtagttttccttccaaccatgaaagaggcacatttgataattctcttctccatactttataattatatggttgaaaataaagttcatataacgtcttaccaaaacgtcctagtagaaattcttcaaagttattagcacctttccctgcatatttaatcaaatctatcaaatctaaaataaatttcttacaaatttcaggatcaagcatatatacataattttcaatcggatatggaattatttgtccattattcatagaaattgaagaatttcttttagattttacaaaatcaccttctttatcaaaaaatgaccaaaaccaatcccatacatctttccttttagtattaaagacatgcccccctgttctatgaaacaaagaaccattaattaaatcacacttaatcattccaccaggtctagtttctgcttctaaaacgataacttcctgattatctttccgaagcaattgtgctatagaaagtcctgatattccaccaccgataacgatatatctcatatatttatttttgtttatttaaattcataatatatttgtaaactgtaaatacaaatactagcggagctaaaagtagacttacatacaaaattggttcttttttataatgaatccacatttttttataagtccctttcgtatcaaatccccaatatttattgtatcgtataaaacaagccatagctaactgagatctgaagtgtaaaaagactcttcttttatcagcttttaaagttttatcatcaatgtaccctttcgacttaaactccaacaatattttaaaatagttatcaaaaaagatctcaaaccagttataacctttccttattcctatctgttcatccggaataaaattaaatatccgattattataaatcaaacattttccattgttaactataatcttgtatgtccaataatcttgaggaataagagattctgcatatttctttttctcagtcaattgatcccaatgctctttccatacaccaaaaaatggccagtatgttacaaatattgaaactctattaatgtaatcattcaagttatcacaataaatctttttcaagtcagaataagccataccgttaagaaaaaacaatggagtttgatccttcaaatgatttctaatttcatttagaataaaatgtaaacagtcattatttatgataacataatcatttattaatttcaaatatttcccatttgctaaagataagactctttcaccattattaaatcctatatttttcgtgtttctgtaagaaacaatatttttgtatttattagagtaaaattgaataacagatggagtatgatccgtagaacaattatcaacaataacgacttcggtttgatcatcaaaagcttcattactcgttaatatatacaaacttttattcaaaatatctgcacgattataagtcggtatacaaattgataaaattggtgtattagccatgccattgttttttcttcgttacaaatattaaatatgcataaggtaaaaacaagatatttataaataaatatcccaatataaccccttctaccccccaaatattagatgtaaaaaatatcaccatacaacatactaatccacataaaatcgagtaaagtaaaaaaggctcttttttatgacaacgtaaatacgacgcccaagaaactacaaaaacattcaacaaaatagacagaaacaaataaaatgtatttttacatgacaaaaacctagttgtcagcaactccccattaattgatatacatatcttatctgcaacaaataacccaccaataaacacaaagaataaaataattattacagccaacatttgttttaatgttctagaaaaaattagatccaattcactatatttttttaatgcaacacaatttgacaataaaggaatttttgtatttatccagctcattgataaagcctgtatgccatttaacacttgtaaagtcatgccaatttgtcctgctataatagcacctccagttgcaaatatgaccggagtaaataattgatatattaaatatccacttatccaactaattgctattctccattgaaatggaaagatttcatctacatattttattctttcaataataggatttttatatatgtctattagtacttgcttcattttagagaaatatacatataaataccacacaacagcagataaaacaagacttataccaacaacgtataattttagtcctccatacaatcctagccacatcgatattggcaatataagttgttgatacaatgaaattagactcatttcttcgaccttattcatacctaataaaaatgaatttaaaggtgattgaaatagccgtaaacatgtaccaaaagaaattaaaaaccatggaattttccatgaaacattatcaccttcagtatcataatgagtaaaaaatacccatccaacaataatcaatataaaaaaaagaagtatagacaaataaaaataccatttaatacaaaaatgcaatagtgatgacaaccgtgatttatatatagacttatcattttcaactgttacatatgcatattcatgagcaacaaattgagtaataatattagtcaatcccaattcaaagaatacttgtacagcaaccaaactaccaaatgtatagtaaaacccttgttcttcttggcttaagtatttcgctaagaaaaagattgttactatattagaaccagcttgaactattcgagctgcagatgaataagcaatagctttatctataccaagtttatttattaatttcttcattaattaatattaagacaagtatagctcctcccatgtttagcacaatacaaaaagacattataaatcaacatttgttcctaaatctcgctaacccttctgaaatatcaattttaggaagccagttaggtatactattgtataatattggaaacataacttcgcgttctttgtaagatttacctcctaaattcacattaatttttttccctaatatcttttcaaaaagagatataatatctttcaacttatatctttttcctgtgcatacaccaaaaacaccaactctagaaaattttcgattacacatatattcataagttttcaaatatgcactacatacatcacttatatggataagatccaacatttgctcacctggagatatatctagcgtctgttgtgttcctgcaatttgacataatttatttaggagtttaggacgtttatcattttctccatacacatcaaaaagtcttaacgaaatcacgttatattgatatcgatcaatataatattggcacattatttcaaacgattcctttgttgctgcatataaatctacaggattatataaatttgaattataattttgccaatatgaaccggtacaaataaaatttcgacatgaagacctcaacatagcctccatcacctcacaaccaaattgaatattactttgaattaagtttgctatttgacttggtttacaatctgttattactgctgcagctaaatgaaaaactacatctggattattaacagaaaaccattccaataaaatcgtaatatcaccagaatattctataatttcaatttcagacaatatatcttctatattagaataaccaaaccttggatctgcaataatagatatacaccaatcctctttcaataaagtttttatcaaattggaacctatatatcctgttccaccagtaacaacagctctcttcattttaggctaaaaatttagaaatttcaatcaaacataatttgtaagtacaattctgcttatactttttataccagtccacagtaagttctatacattggtcaatatccatcctcggctcccaccctaactgaaacttagccttattaatatcaagcatcaataatttagcctcatgtaaagcgttcgaatcagaaagatttttcaacttccccctaccataattctcaataaccttcgttgccacttcccacactgaagtaatactttccatcctcggaccaaaattccaactttcacaatattgggtaggtttactccacatcttactagccaacaacatataaccacttaatggttccaatacatgttgccaaggacgaatggctttcggactacgaatttcaataggtttgtttacttctatagccttgatacaatcgggaataattctatccaaagcccaatctcctccaccaatcacattaccagcacgaacactagctatacttttaccatgtttttcatattgctctggattaaagaaagaacgtctccaagaagcaattgctatttctgctgctcccttactactggaataagggtcataaccacccatcggttcattctcacgatagccccaaagttgctctttgttttcataacatttatcagtagttatcatgacacctacctttacgctatccgttatccgtatagcttccaatatgttaatcgtccctattacattcgtttcgtacgtttcaacgggaatttcataacttaaacgtactagaggttgggcagccaagtgaaaaacaatttcgggttgatattcctgaaaaatatctttcattcgctgactatcacgaatatcagcacgcaggtcagcttttatttttcctcctattccggacagcacataattatctttatctgtcatcggatctttagcaaccccaatcacttccgctccaagttcatgaagccagatagaaagccagctacctttaaaacctgtgtgtccagttacaagaacacgcttccctctataaaaatttttaaatatatctatatccattatttaccaaactttccaaggagctatccccttatcccacatttcattgagttccacattatcacgtaatgtatccatcggtttccaaaaccctgtatgacgataagcatgcatcttaccgtcctttgccagaccttcaagaggcttacgctcaaaaacaatagtatcatcacacgcaggaatatattcaaagaccttaggttcgcaaacaaaatagcctgcattcacccaattacgatcaccatccggtttttcttgaaaggaaagtaccttattattattcaaatctatttgcaaagctccgaatttacctccgggcttgtaagctgttaatgagatatcacaacctgataattcatgttccttaatgctttctgctatatttatatccgccaccccatcgccataagtaagaacaaagcgttcatcaccaatatatttctgtacttgtttcagacgccctcccgtttgggtattcaagccggtatcaaccatagtcactttccaattttcagagtgattatcaagtatttcaacactgttattggacagatcaactgtaaggtcgctattatgacgaaaataattggcgaaatattcttttataacatattgtttataaccgcaacagataacaaattcattaattccataatgactataagtcttcataatatgccaaagaataggctttccacctatttcaaccatcggtttgggaataagattggtagcctcactcaaacgggttccaaaacctcctgcgaaaatgactgctttcattattctttacactttacggaatgcaataaatttcttgattgtggaaatcatatattggagcatttcttcagtcatacccgggtaaactccaatccagaaagtattattcaatataaaatctgtacctttcaaatcaccgacaacacgataaccttcaccggtttgtcgcatttcattaaaagccggatgtttcaacaggtttcccgcaaaaagattacgggtttgtatttttttactctccaagtattcagacaattcattacgagtgaagcctgcatcttcctttactgaaataagaaaaccaaaccaactgggattagagttcttttgaggttcaggaagtattagtccttctatatccttcaaaccatcaagtaaagtctgaaaattctttctccgagccaatacgatactgtccaacttatctaattgagcacaaccaatagctgcttgcatatcggttaatttcaaattataaccaaaatgagaataaacatatttatgatcataagctacaggtaactcaccaaattgtttactgaaacgatatttgcaggtattatcaacaccacctacacaccagcagtcacgtccccaatcacggaaagaattagttatcttattgagcaatggatcatttgtatacacagcaccaccctcacccattgtcatgtgatgaggaggataaaaactgctagtaccaatgtgccctatagttcctgtctttctcgtctcaccattgatggtatattctgaacccaatgcatcacagttatcttcaaccaaccaaagatgatgacgatcacaataatctttcactgactgtaagtcgaaaggattacccaatgaatgggcaatcatgacagctttggttttatcagaataagcagcttccaattgagttatatctatattatactccggaatcgttacatctacaaacaccggaattgcaccatactgaatgataggcgtgactgtagtgggaaatccacaagccactgttataacctcatctcccttttttatacgacgttctcccaatagtggagaagtcaatgtcataaaggctaataaatttgcagaagacccagaatttgtcagggagcaatatttaatccccagccagtctgcaaaacgtttctcgaatttatgagcccaaggtcccgctgtaagccaaaagtccaaagatgaatcaatcaaattaacgagttcttcagcatcaaaaaaacggccaccataatttacaaaactttttcccggttcaaatacttttaagttccgatgaacttcatcataatattcacgagataactgaagaatttgtttcttcagagtttcttttttattcataagctgatctattttttagtaagatatatttgaagcattcattatatacctgaaaagatatcttaataagcatttttttctcctataattacatttgctatggtcttataaatgatatataaatcaagcagtaaggtccaatgctccatataccaaatatcagccttaacacgaccctccatctgtgaaagttctttcgtttcaccacggaatccgttcgtttgcgcccaacccgttactccgggtttaatgaaatggcgcaccatatacttatcaatcagttgtgcgtaaatctctgtatgagccaacatatgaggacgaggacctactatcgacatttcacctctgaaaacattaataaattgcggaagttcatcaatattagaacgccgaagaaaatctccaaatcgagttttccgaggatcatcagctgttgcctgcttataatctgcctcttcattcactttcatggaacgaaatttatagcatttaaaatcaacaccgttcaaaccggttcgcatttgtgtaaagaatatgggaccgggagaagttagttttattatactccccactataagataaaccagtggaaaaatagtgactaaaaaaatccctgacagcactatatcaaatattcgcttcaataaacgattctccattttgctaagtggttcatatctcaaattcaaaattggcatgtttcctaccatactatgccaaatacgccgggggaaacccttagaaacattaggaacaccatgaaaataaagcaaatgattctcacaataattcattatagaaacattatatcgtccctgttccattgataatgaacaaaatacatgctttatatctgtttttcctgacataaaatcagcaaagctatctggattgccaagatagtcacatttagaagagagagtagcgtttagaacaacatcgaaataccctacaacttcataaatagatgccagagaactctccatttcttcatataacatctgcatattattacctccgccaataaaaacagcataacgtttatgattacccttggcacaatagctaatcagtgaatgacgaattatgatgcgataaatacttaaaataacaaagagtataaaaaaataactaacaaaaaagagtggggaaattataaatattccactaaaagccatgatacaagcccaaaagacagaaaatgttatgatattcttcaacacacgtaacacaagctgatctgcacgaatttctctactattccaagcccttccacgagatgccgaacaggccaaataacaaagacttagcgaggtcatcatcaaagaaacagtacaagaaaaaggcaaagaattgaatgcttttttccaaaagaaaagaagcaggaataaacagaagttcaggatgagtaaatctcccaaaactacaatcaactctactactttatttatttggttagttgatgccattattaccttatctattgattttaagcctgtatttctttgaacttattcagaatattttctccgaataacttccaaaatatgacaatacaaacagaaagaaagataaatgccagaacatatatttttttacttgtccccgaagggttcaatggcaccacagcaggctctacaacagcaaatactggtttctcttcctgaactttagctctggcgacctgcaattgactcgccacctgactgtacacctgataagccagactcatatcattctgcaatcgttcctgctcggcgcgggcactttgcaaaataatattatcatgagaatctagataatcagcatatttcttctgcgcaacataatactcttgctggcgttctttaaatagtctctccaaatagacacaatcttctttcgctttggaagtacgataatttataatatattcctgtagctttcctacaacagaatcagcaacgattgcagctaccttaggattttgaaaggtgacagcaactgtggtcatagccgttttcttatctacagaggcagcaatctttctttttagagtttcaatcttcacagactctttcttagataattcgattgtaccatgacttgctttatcggaagacatgaattcatcctcttcgctgataaataacgattttactccaccaattgccataccgggaagtccgattacataactccaccaaggagaagactcctcatccagataagcattcaaggtcatcatttcatttttcaatacaggtattttcattgtggaaagttccaataagaaaggagtggaagatacaatatctgcagataaagaagcattcaaagcatcactgccatcacccatagtaacgtcacttcccaagaaagaagctgccaaaccagatagaccaccacctttagcacttcccatctccggagaaagagtcacttcaaccgtgtactgtttaggaatacttattgcaacaataacaccaattatcagtccgataccagctgccttataaatcttcttacgaatacttacaaccttacgaagaagatccatcagatcaatctcaagctcctcattcgtatgaatatcctgttgctgtttcatctctttttcagatttttgttccatcagagtagtcgtaaaaaggattcgttatttctttattaaattagcaatagaagcaaccatcattcccaatgtactaaatgtagtagcataacctaagatattacccatattagtccttttcttagctttactgggcacaattatctcacatcccggttcgatctgtttcttaccactacctttcaccttagtcacctgaccattcatataaacgatgaatttcttactctttttcgcattttcagaataaccaccagcttgattcaggtaataatctatattctcaccctctatatatgaaactgtattcggaaccattacggcaccattgattgtaaccgtattattatttttcggaatagaaatcacatcaccctcacgcaagacaatatctgctgtactaccagggttagctaatgccttttccaagtcaataccaacactaaaggtatcttccacacgaacacccaaagagtccatcatagcttcacccaactgtctgctcatcaagcggatcacatcacaagaagaagacagttgaaataaaaaagagattaccaccaaatttgacgaagaaccagaaaaatgattttcatttctcatattctcataattattttataataatcttataaccagataattactgaatgagaaacgttttgagaaagcctatttctcatagtttctttagtgaaataggcctcaaaacagttatttctcatctattttcggggtatttctcatactgttatcctcttcgttcgactattttttctttatatataccctgtgtgctcctcttcctgtgatttctattccagaatccggttgatgtccccactgtcttagttcgttggttgctgctgtttgcaacaatcctgttagtttgcgatattcccaaacggtcaggaagggatgttcatccagatactttagagctaatgccagtcgttgttccgatgtgaatttattagaggatcgttgctttttccagggtgctctttccagttggcatctttcgctgatatttctcaccatttctcggtctacccggaaatttacacctcctataaaaatactttgtgcgttgcgatgactccccccttcttctggatcttcccgctccttgtctctgcctaaagtaagagagggagtaaacgttcctattccgtctatctttaccgagcgcccttctgccatcaaatgcgccatttcaatggcggtctgaagtagtacgccttctatgtctcctgcactgaatccactgacgtcgccaactcgttgcgccaactcttttatgcttgtattatctatccgcgcaaatttaggataagtaattcttttgcctgttttctgaagatcgggcatctcctctatgatatatcttgccatatcatctattgtttaaagtattaatagataagttcttttgtattagaggcaaacttcctttcttctaatagtaaagttccttttgattaattataaactataaatgcaacttttgtttttataattgaagcttgcgtttataaaaacaaagctttcatttttataatcaaagcttgcatttatagtttactcttatacaaagataagttttctatttgacaaaaagaagtttatccttaataaagaagaagttttctattaatagtttgggagggaatgaagatgattaaagagaaaggatataacgggattttatgcttaatatattattttctaaaaagtggatgcaatgcttctgttagtttttagaaaagtgtatatttgtaatattatgagtcatactaatatcatgcaagctgaagaaaatgatttggtaaacattttatctttgcaaaagaaatcttttatggtggtggccgaacgaatgaataaattcgatcttccccctttgttgcaaaatcaggatgagatttgtgatgagtatcagacaggcattattctaaaatacgtatcagatgatggacagattgtaggttctgtcaggggatgtatggatgaaaatagagtatgtcatattggtaaattgatagtgcatcccgattttcagaataaaggtataggtagagaacttatgactgaaatagaacggttatttcctcactgtcataagttttctctttttacaggcgaagagacacccaatactttgcatctatatagcaaagtcggttataatattgtatgtagaaaagaaatggagggtatcagcatgattattatggaaaaagaaaaacttacttatagagattttacgtttgacgatttagaaactgtttgtaaattacctcgaaacaagcaggaactgttttttatgtttcctaaagctgattttcctttaacaatcaatcaattaaagaatacaataaaagatagatttgattcgactgttgttttatttaataatgaagtagtagggtttgcaaatttctatgaggtaagagaatctcaatattgtgctattggaaatgtaatagtaagtccttgttttcgtaatcgtggcgttggcacatttctgataaatgctatggaagatattgggaaaaagaaatataatgtatcggagcttcatttgtcttgttttgatgctaatacgagtgggcttctgttatatactaaattaggatataaaccctatgaaatagagaagtacattaataaggaaaacgaagtctcggctttaatagaattgaaaaaagtgctgtgattcgaaataaatcacttatttgattctgttatctcctgaaagtatgataacttaaaaaaatgcgagaagtatctatgaccaactataacttacaacgatttttagatgcccagcgaggtgattatgaacaagcccttgcagaagttagaaacgggcggaaatattcccattggatttggtatatatttcctcaactgaaaggattgggcatgagttataattcacagtattatggtcttagcggcaaagaagaggctgaagcatatcttgcccatccaattttgggagaaagacttcgtgaaataacgtctgtttttcttcaattgaaaaataaaacggcgcaggaagttttcggttcgttagatgcgatgaaagtattgtcatgcatgacgctttttaatgaagttgcttcggatgatttgtttcagcaagtgatcgaccattattttcagggtaaagtggatgagacaacaaaaagaaaattggaataataactaatactattttatatgggctgtttaatgaatctattgtggctgctgcttggtggtatctttactgctgtcgaatatctcatttcgagtttattgatgatgctgaccattatcggcattccttttggaatgcaaacattgaagttggccggacttgctttatggcctttcggtaaagaagtcagaagtgggaaccgttccggtggctgcctctatatattgatgaatatcctgtggatatttctgggtggcatttggatctgtctgtcacatttggttttcggggctatattgtgcattaccattatcggaatcccttttggattacaacatttcaagttggcatctttggcattatcgccttttgggaaagacattgtaacagtgtaagagtagttgggagagagtatgcttataattaaaagttataatgcataattagaaactattggtgggtcttgattgtttaccgtacctttgcacccggaaaacgattaaagacaaaaagatatgatttcaacagctacaaaaactttgcaggcaaataataagatgatttatgttgcgctgctttccactctgactttcttcctgtttttagactatattccgggattggaagcatggtcggcttgggtaactcctcccgttgctttgttcctcggacttatttttgcattaacttgcggacaagcacatccaaagtttaataagaaaacatcgaaatatctgttgcaatattcagtagtaggactgggattcggtatgaaccttcattctgctttagcttccggtaaggaaggtatggaatttacggtcatttcagtaatcggaacattggtaattggctggttcatcggacgtaaattgtttaaaatagatcggaatacagcttatcttatcagttcgggaaccgctatctgtggtggtagtgctatcgcagcagtgggaccggtgttgaaagcgaaggacagtgaaatgtctgtggcattaggtacaatctttatcttgaacgctattgcacttttcattttccctgccattggtcatgcattgaatatggatcaacaacagtttggaacatgggcagctattgccattcatgataccagttctgtagtaggcgcgggagctgcctatggtgaagaagcattgaaagtggctactactatcaaattgacccgtgctctttggattatcccgatggcttttgctacttcctttattttcaagagtaaaggacaaaagataagtattccatggttcatcctcttcttcgtattggcattggtggtaaatacttatttactggatggagtgccacaattaggagcaactatcaacggtattgcccgtaagactttgacgataactatgttcttcatcggtgcttctctttctattgatgttttgaaagccgttggaattaaacctctgattcaaggaatattgctttggataattatcagcttgagtacattggcatacatttattttgtataagggataaaagagagaatgatataaaaaagaaaaaggtgggagaatgatcgtaaacgactttctcccacctttgtttacttagctttcagcctacggataaacagatctaaagctatttatttcttcttcaattcttcaaaaatcagtccttccagttcttctgccaattcaggattatccataatgcattgtttagcagcatcacgcccttgtcctaacttagtatcgttgtagctataccatgaaccgctctttttgatgattcccaagtcagcacccaagtcgatgatttctccggagtgggagataccttcaccgaacatgatgtcaaattcagctctgcggaaaggaggcgctactttgttcttcactactttcactttggtcagtttaccaagaatctcttcaccatctttgataggttgactaccacggatatccagacgtacagaagcatagaatttcaatgcgttaccaccagtcgttgtttccgggttaccgaacataacgccgatcttctcacgcagctggttgatgaaaatacaagtcgtacgtgtcttgctcacagcagctgtcaacttacggagtgcctgagacatcaaacgtgcctgaagacctaccttgttgtcacccatgtcaccttcgatttccgctttaggggtcagtgcggctacagagtcgataacgatgatgtcgatagcagaagaacggatcagttgttctgcaatttccaaagcctgttctccgttgtccggttgagagatataaagatcatcaatgttcactcccagtttagatgcatagaaacggtcgaaagcgtgttcggcatcaataaaagcagcgataccgccagctttttgcgcttcagcaatggcatgaatagccaatgttgttttaccggatgattccgggccatagatttcgatgattctacctctagggtaacctccaacaccaagtgccacgttcaaggcaatagagcctgtcgggatcacttctacttgttcaacactatcatctcccattttcatgatagaacctttaccgaagctcttttctatcttttccatggcagcctgtaaggcttttagtttttcgcttgatgccattttattatctgtttcaaaattaagttcatctttctttgccataccttatttttatataattaatggagttattgatttaaaatctgtgaggcatgttccttggtcttcacttctttgggagtgataatccgttctacgattccttcttcattaatcaggaaagtagtgcggaaagtacccatgtaagcacgtccgtacagtttcttttctccccatactccaaactcttccactaactttttgtcagtgtcggcaatcagggtaaaaggaagattgttcttttcgataaatttctggtgcgacttttcattgtctacgctgacaccgattacttcatagccggctttacgtagttcggaatagttgtcgcgcagattacacgcttgtgccgtgcaccccgatgtactgtccttcgggtagaagtacaacacaatcttttttcctttataagcacttaaacggatttcttcacctttttcattgatgcctaagatttccggtgctttatctcctacgtttatcataactatctttttaatgaacaggtctactcttataattccagatttttgtcgaactcttcatgccagggaagaccttgcttgttgagttgttccataaacggatccggattgaactcttctacgttgtttacacccgggcgtttccactcacctttgaagaacatcatggctccgatcattgccggaactccggtggtgtagctcactccttgcatacctgtttcccggtaagcttcctgatggctgcaattgttgtatacataataagtacgttccttgccatctttcaaaccacggatacgacaaccgatagaggtttctccttcgtagttttctcctaaatcctgcgggttaggcaatacagctttcaagaattgcagcggcacaatcttcactccgttgtaatcaacttcgtcgattcgtgccataccgatgttttggataacgcgtaagtgagttaaatactcttgtccgaaagtcatccagaaacgtgcacgtttgattgtcgggtaatgtttcaccaatgactccagttcttcgtgataaagaagataagaatcacgaggaccgatgttcggatatgtcaggtctttatgaatttccagcggaccggtagttacccatttgccattttcataatagcgtccgttctgcgtaatttcgcggatgttgatttccggattgaagttcgtagcaaatgctttatgatggttacccgcattacagtctacaatgtccagatattgaatctcatcaaaataatgtttagctgcataagcggtatagatgccacttactcccgggtcgaatccgcaaccgagaatagctgtcagacctgcttctttgaagcgatcgtggtaagcccactgccaactgtattcaaagtgagcttcatccttcggctcgtagttagcggtgtccagatagttcactccagctttcagacaagcttccataatagtcagatcctgataagggagagccacattaatcaccatttccggtttgaaatcgttgaataaggctaccagctcatctacattgtctgcatcaactttagctgtttttatattggggttacctattgcctcgacgattttatcgcatttctctttcgtacgactggcaatcatgatatctgtaaatacatcggcattttgtgccactttgtgcgcaacgacagtgccaacaccgcccgcaccaataataagaactctacccatttcgttaattgcgaattaaaatattaagaatattggaattgttagctttgcaaatatacgtgattattttcagataatcattcgcagctacccctttttatttgtaacgctgcaaggttccattttcaaattccagtgttttgccattgtagaaccaagtttcgaaacgattgtcttttttcagctcgatttctatcggatcgccaatggataaacgacattccactgtactcatgcccgtctccagatctccccgggagataatctgccaacgattttctgtgatacccggatattttttatgtatatcttcgaatccgaaaaagtcttcgatataattttcatttctgacgataacatcatatttcagatcggtttccaattcatagatcgctccgtcattgtcttctaatgaaagaatagccagactgccgggaggagataatctaatatctttgatttgcagaactgtatatcggggcaggtgaacgcgtgattcggtctgcttgtcttcaaatgatacgattcttttggctggcagcacctttttaggataaactgtcattcccatatatttatttttcaggctttcgatagtgcctagactcttattggtgaaactgaatgcatttgagaaatatttcattctcttttctccttgaaaatcattcaggtccatgccggagtttgttcgtgagagggcaacttccagataataagaatgtccctgtgtatctttgaatacgatttttgccggatatgcctgactgccgactccgatagcggtaatcgttgcttccgtattgacgggaatggctatatcccggtaaccggaataattgttggcatcgtctatccggacactttctgcttgtatatagactgtttttcctaccaacagctctttagcagtatccacatctttcagataaaccaatccgttgatgccggcacggggagccttttcggagatctcctccagccgcatattctttatctcataataatattttcctccctcacattcgaagatgaagcgagtggagtagttagtcccgttggggatattctgagctttctcttcagttcccgtgaaagtgagtattttatgtttcagcaggctgttgtctacccctttctcggtctcgtagctggaaagggtgggaaggaacatgctccgtggagatggaacgaacataaatttcatcccgggtgtccatttgcccagcggtagcaacggaaagttacttttgataaactgttcttcttggcctacagggatttcctgtgcagaaggagtagtgacgatgtaatcactttgggctatgataggagacgtaccacagcagaatagaatcaaagacaggacaattattctcatatttgtttactttaagtgaactatgtaaattgttcgtttgttgtacatttactggcaaatgtatatattttatgttgcattggatgttatttcccaatctttttgatatctttgccctcgattttaacttaaacgttataacaatatgaagaaagtatttgtttcaatttgcattgctggtgcagcacttgcaatgtcttcgtgccgttcggttgagaaggcaattcccctgtcatctatcaatggtgaatggaatatcatagaagtcaatggctcgaaaatcactccgggcgaaagtaccccccttccttttatcgcttttgatacagcaactggtcgtgtgtccggcaatagcggctgtaatcggatgatgggtagcttcgatgtaaatgcgaagccgggaagtctcgaacttacaggaatggctagtactcggatgatgtgtccggatatgactactgaaaataatgtattgaatgcttttgcgcaagtaaaaggatataagaaggcaggtaaggacaaagtgtttctttgcaattcgtccaaccgtccggttgtcgttctacaaaagaaggaggctgatgtgaaactttcggttttgaatggagaatggaaaataaaagaagtgaatggtgaagcaattccttccggaatggaaaaacaacctttcattgcttttgatgtgaagaaaaagacaattcatggcaatgccggatgtaatttgattaatggcggttttgaaaccagtaccagcaatgccaaatcaatttcttttccgggagtagcgagcacaatgatggcttgtccggacatggaaacagaaggtaaggtgctgaaagctatcaatgaggtgaagtcattcgatgtgttgtccggtggcggcattggcttgtatgatgcaaatggcgcattggtcatcgtgctggaaaagtaataaatagatcaatctatataataggatatgcctgtgtcgcacatgacgacacaggcatattttttttctttcatcgaaccagagtcgtctgtatttgtttaaagaaacagttgctgactggctttgaatatgactatgtcagcagtgtttatttattaaaactgtctttttggcagatattatgtcatgcattcgtataatttctttttggcacacggtttgctttttagtaagcgtccgttcgcgacgaggctccttgataagagccggagaaacaaccggacaaaaagaaatcaatgaataaataataaataaaaaaataacgatcatgggaaaaattattggtattgacttaggaactacaaactcttgtgttgccgtattcgaaggtaacgaacctgtagtaattgcaaacagtgaaggtaaacgtacgactccttctgttgtcgctttcgtagatggcggtgaacgtaaggtgggtgatcctgcaaaacgtcaggctattacgaaccctacacgtacaatcttctctatcaaacgtttcatgggtgaaacttgggatcaggtacagaaggaggtgactcgtgttccttataaagtagtgaaaggtgacaataacactccgcgtgttgacatcgacggacgtctgtacactccgcaggaaatctctgctatgattcttcagaaaatgaagaaaactgccgaagactatctcggtcaggaagtaacagaagcagtaatcaccgttcctgcatatttttccgactctcaacgtcaggctactaaggaagccggacagattgccggtctggaagtaaaacgtattgtaaacgaaccgacagccgcagctcttgcttacggtctggataaggctcacaaagatatgaagattgctgtattcgaccttggtggtggtacattcgatatctctatcctcgaatttggtggtggtgtgtttgaagtactttctacaaatggtgacactcacctgggtggtgatgacttcgaccaggtaatcatcaattggttggtacaggaattcaagaacgacgaaggtgctgacttgactcaggatccgatggctttgcaacgtctgaaagaagctgctgaaaaagctaagattgagctttcctcttctacaagtacagaaatcaacttgccgtatatcatgccggtgggtggtgtgcctaagcacttggtgaagactttgactcgtgcaaaattcgaatctttggctcacgaattgattcaggcttgtcttgaaccatgtaagaaggcaatgagtgatgcaggtttgaacaatgctgatattgatgaagtaatccttgttggtggttcttcacgtattccggctgttcagaaattggtagaggatttcttcggcaaggctccttctaaaggtgtgaatccggatgaagtggtagcaattggtgctgctgtacaaggtgctgttttgacagacgaaatcaaaggtgtggtattgttggatgttactccgttgtcaatgggtatcgaaacactgggtggtgtaatgactaagttgatcgatgctaacactaccatcccggctcgtaagagtgaaacattctctactgctgccgataaccagacggaagttactatccacgtattacagggagaacgtccgatggctgcacagaacaaatcaatcggtcagttcaacttgacaggtattgctccggctcgtcgtggtgttcctcaaattgaggttacatttgatatcgatgccaacggtatcttgaaagtatctgcaaaagataaggctaccggtaaagaacaggctatccgtattgaagcatccagcggtttgagcaaggaagaaatcgaaaagatgaaggctgaagctgaagctaatgctgaagcagataagaaagaacgtgaaaagatcgacaagctgaaccaggctgacagcgtaatcttctctactgaaaatcagttgaaagaattaggtgataagttgcctgctgataagaaagctccgattgaagctgctttgcagaaattgaaagatgctcacaaggcacaggatttggctgctattgatactgctatggcagaaatcaatactgctttccaggctgcaagtgctgaaatgtatgcacagagcggtgcgcaaggtggagcacaggctggtcctgatatgaatggtggtgctggccagcaagataacagcaagcacggagataacgttcaggatgctgacttcgaggaagtgaaataagtatcggtaaacaacgataactaaagatagaaaagtagggtgtaactcaatgagttacaccctactttgtttttaacactttctgatagatttgcttgtttctcgaatctttattgtatatttgtaccatatttgtgccgcgataaaaaagtaggaaatctgcgacaaaatataaacgggttgaatacaaacaagtaaaaatcagcattatgccagcagcaaagtttgaaataaaacggaaatgccaagtgtgcggtcaggagtttattgccaagaccatagaatcgtggtattgctccaaacgctgttccaacattgcgtataagcgcaggaaagacgaagagaagcggaatcagcgattggaagaaattgtaaagagcatcccgaagcaccaagattacatcaaggtgtcggaagcctatgccctgttcggcatcagcaaagatacgctgtatcgtctgatacataaagggactatttcgcacataaatcttggaactaaccaaatccgtgtcagcaaagaagaactgctgaaactctatccgctacgaaagaaagctctgacaaaacccaaacccgttgcaaaactatatagtttggagcctaaagactgttatactatcagcgaaatatccaagaagtttcatttagaagacagtacggtctatctacatatccgtaaatactctatccctacccggcagataggtaacttcgtttatgtgcccaagaaagaaattgataacctatataaaggaatgaagcaatgaagaaagcgttggccaatacacgagtttcagtaaaactccgcaaatcggaataccgcgaggaatggtacctgtatgttgaagcttatccggttttccaagcagacaaacccactccccaaagagtgcgtgaatatctgaaccgtactataaccactcccatatgggataagtcgcggaatgcccgaaccgacaaggacggcaagaccacttataagccaaagcgtgacttgaacggcatcatccaatgcaaatctcaattagaccaagaatcgtgtatctatgccgataaggtgaggagcctgcgccaaaaggaatacgataacgcttcgctttattctgaaacggatgcagaacaggcagagcagctagagcgttcacgttgcaacttcatagactacttcgaccatgtgcaacggttacgccacgcccatagctccgattccattatcatcaactggaagcgtgtacatgaattgttgaaaatctttgcgaaaggagataccatccttttctcacagattgacttgaagctgatagaatcattccgtatgttcctattgaacgccccacagggaggaggcaagaaaggtgtcatctcgcaaaatacggcatccacttatttctccatattcaaggctgcattgaagcaggctttcattgacggctatttgacggttgatattggggcaaaggtcaagggtattcaaggccaagaaagccgtagggaatacttgaccattgaagaactgaaccgcttggctcaaactccatgcgacccgttgttgaagcgtgccgccctcttttctgcacttaccgggcttcgtcattgtgacattcaaaagttgaagtggtcagagatagaggtattcaatggtggttaccgtttgaactttactcagcaaaagaccaaaggcgttgagtatatgcctatatccgaacaagcatttcaattatgtggtgaaaggaaggacggcgaacaattagtttttggcggactgccagacccgtcatggattaaccgtccgataaagaaatgggttgcagaaaccggaataacgaagcacatcacctaccattgttttaggcactcgtatgcaaccctgcaactcgccggaggaacagacatttatactgttagcaaaatgcttggtcatacgaatgttcgtacaactcaagtgtatgcaaaggttgttgatgctaaaaaggaagaggctaccaagacgattaagcttgatttaccgtattgttgactataattttatattctaaatcaaattattaggtaaatacgtaaatagttttatgtcacaataaaatatattgttgtttttcgaaataattttgtatctttgaaggtataagacaatagagtgtaattatatggcaacaaataaaaacattaatcgtatcaaagtagttctcgtagaaaagaagaaaacgaacaagtggcttgctgaccaaataggtaaagatcaggctacagtgagcaaatggtgtactaacacaactcaacccactcttgaaactctagtagaaattgcaaggatacttgaagttgatattcgggagttgctcgtacctacagacaatcagaaaattatgatgacgatcttgtaataactaaatctaatagaatatggtcagcaaatcaataatagaaaaattacgtgagatatatcaatctttgcctaaggtagaactggttgacaagggtgatggatgggtgaaccagtatgatttcttacgtgctgttggaaaagtaggtatcaattataagagtctggggtacgattatttctatgaatttttaacagattctggattgttttcattctggacagatttctcgggagaaaaacctacaaggtatgtaattgaaaaagctaagccaaaatctcacgaagagcaaagaagaccacaatacaatcgtgcagcaacccaatacgtagattccgaggaggtcgttaaaatcaaacgcagattgcgtcttgagaacaatcagtttattggtcagtttgcgcctcaaagaaatgaaggttggtttacgataacagatatccgtaatactgattttacaaagattgaagataaggaacgtggtataaagaatctgtctatctcattcagaagcaacaaggagttcaaccgctatgcatactacaagttcacttgggtattgcttgaaaccgatcctctcaagttcggtattgacttgcatgaggaaataacaccaatttaccccaaagacattgtgagcagtctttacgagggcattatgcgttatcctgcaggtgctgcaaagaagattgctcgttcgcttgatactctcaaaaagcaacttacacaaagcggtaaggaagtattcatctatgagttgttgcagaatgctaacgactatcctcgtcgtacaaaaattgatggtaagattcaacctttgcctgttgatgtagagttccatattaccgagaactacttaacattcgagcatacaggtgaatatttcaatccgaagaatattgcagctatttgtgatataaatgatggcgagaagtctgacaataccgaagccatcggctacaaaggtattggttttaagaccgttttccttgacaacgactatgttctcctcaatactggtaattacacattcaggttcgacaagtctgctacggatgtaatcaatacaccatggcagatattgccaatctggacggaacataatgagatcgataatgaaatcaagtctgtattccgtcagcatcctaacgaagagttcagagtaaagttcgctctccaaccacgagataaggaaattctgaccgacgaagacagagatgataactacatcgatttgtttaccgatgtatttgaatcagagcgcgtcatattgtttatcccgaacatcaagaaggttagcatctttattgatggtcaggatgaaccgattgtacgtgagaaagacaataaagactggtgtgtatcagattctcttgtagatgatattcctgaggatattacagataagataaacgatgtcttggaaaatccagactctcttcgttcggatggttatgagaaaatacctgagaagtacatgaacttccgtaagactgcggtaaagtttgcgtgcaagaaagctgaaagaaagttgatgccagttgatgatgccatactttattgctatctgccagcaaagcgggctgattggggcttcaatttcctaatgaacaccgatatggtgcccaacggacagcgtgatgatattgaggatatcgagctcaatcacgttattgctcgtattgcaggtaaacagttcttttattggatcaagcagcttattgaaagcaaaaaatacgaccttgactctatctttgcacttatcccagactttgatgagtgcaagaagagacgcgtgtataagacgtttatagaggagttccaggaagaatttgaaaagctcataaaagaagagccttttgttccatgcgtggataaggatggtgaacaaacctttgaatgcatcgacaatattattaacgacatgactggcatgacagcgaacggagtcatttcagacgaagacttcataattcttatggagttgggtgactactccttgccagttgacgagttaagacgatcggaggcatttatggatttcttgtacaagcattctccttcgagccttgatgtaaatgttgatgctgttgtaaagaaatgtgagggaactgatttccagacatggttgacagttcccgaaaacaatacacgatttataagacattggttgagtgaggatgaactaaacgagtttgcgaagaaaaatatatttattgaatacgaaggcgatttgtttacagcaggaagtctctactatgattttgacacgaattgtaatggaataggattcttgcgtagatttgtaccgcatctttgcgaggcatcaagagcaaattttgaggaagatgaaaattggaaatcatttgcagacaagtatttcctgtctttctctgctgcgtctatgattacagattacattctatccaatgaggatgctatggcgttgcttaacgtaccaagcaattctgttgcattctatcgttatcttgcagtaaaggaagttgatttaaaggctaacaagacaaaggttccgtacattaccgaggatggtggtgcaagtaccgactataccaattatcactacttcttcaacgaagatgctcatggcttaacacgtgagaaatggttgggcgagaatgttatcaacgtactatcgcatatctattttgatagcctggctgatgacgagaaaagtaatataactgcaatatttgccaaccttggattcaacgaatttaccaaggactccttcatcacgactgtcatagttggagatgccgatttccgagcaaaagtaaacgctgccatagaaaacaattatgccgccaacaaagcatttgttgaatatgtgtacggttgtgcagcgcagttgaaggaaaacgttttcaaggattatgtcttgcgttgtgttgacatccacaaaaatgaggtatatctttgcaacgatgacgtgcgatacttcaatcaggatgcgtatgctcagaacagcacctatgctgacaatatcaatcatgcttggttgcaggatagcatgatgtatgctctatcgaatgattactttgaaggtcgtgagaaggaagaggtaaagaaactggaatcgttcttgcgtcagcagtttggcgttaagaccttcacagacaagtcgttcttcacagatgttgtaatcaagaacaaggcggttatctatgccagtcttgttgatgaggcaactatgctcacattcttggaatacctgaagcgagacgcagacagactctttgatgatactatgagtttcaacgacatcaaggatatgcctttactagcctatgacggaaccatagtaagagcaagggaactgaatattcagtatatcgaatacaacgaggacgcaaagattctgtgcgagaaagcatggtgtccgaagacgtatgttgtgctctcacagaaatataccgatgatttctctcaggatatgcgtcagctgttcaagattgtgaagtttgacatcaataccacaactgacatccttgctcataacgcaaacttgcgtcaatcgtttaatgttataaacaataacgttgatttctggcgatgggtaaaggtaaaccagaagcaaattgcatctgttgataagttcaagactattccgttgcttgacaataacaacgcgcttatcaattgtgcatcgctttacatttctgacatctatcagcaggaacaaattgaggcgctggtaactaagtatgtaaaggaggcgcagtttgtgtcttcgtcttacatcgaaaccgccaatgagaacgagaaggcagagtggatgaaattgttcaggaaactcggtcttaagtccgataacaaggatattcttttctcagacatcttgcctaagctttcaactattgaagttgagtctttggattcggttgtagcgatgatgaccaagcaccttaaagacctgaagaataaatgggcagaaaggaaataccaaattatgcagttgagagttcgtactcaatatgctggttataagactcttgatcaggtaataatcgtcaacgtggatgaggattctgtatctgaaccattcaagtacatcactcttgccaacgaagttcatcccgatattctaaaggcaaataaggacttgcttcatgctatctctgaagagtacggtaatcgcaatctcattaccacaaagcaaatgtggattgacgcaaaggttaaggattatcttgcaaagtttactgccgatgaaaatagcgttgcagacattcacattcagtttgtacgtgaagtagccaagatacagagtgagtatgacataaatgacacacttcgtaagcagataaagtatctggtcaagtcgaatgaaacgacatacaagtttgctcatgagctgacacttggaacagaatattctccaacgtgcgactttgaggcaaatggtgtgtctgaattgtcgtatctttctgacacttacatcttcgaaggcaacaaggatatcatcaagcaatatttcaaggtggagaacgtgcatcagaatatgacgcgagaggacttgaagtatctcgcaaaccgcacatttgcttgttatttctggtcgaaatgtttctctcgtcgcttggtcgaatatgaatcatgggtggaagatggatgtttcaataaccgtgtatgcataccaacagagaattctgttcaaaagccggagttgttgtatgcacctcacatagctggttatgctgttcgtgccaaggtacctcaatggcaagagaaggttccttgcaaagctattgttgactctattgacaatcgtgatgctcgtgaattatttgagaagatcaacttttgtaaggctctctcttttgaagattgcctttattaccttgctcgtgttacgcatccaagagaggaagaaactcatttccgcagtatagtgattaattggatgctgtcttcgcctattcaagatgagactttggttgacaactatcgtaaaacgccaactgcagaatggcgtaatggtaaggggcagaagaagcatattacggaactttatgctatccatccagatgcgacacaggaaaggaatatcttccgtggcgatgagtttgttatgcagacaagtgctttcccttatgatacagattcgtttgtcaaggtctgcaacatgctgaagataaaatgtctgacaagttctgattttgtggcaacacctataggcaaacaagatgaaacagctgatatggttgccatactcagacctcgtctgcttatcttgtcggctatcgagaacccagatcgattccaagaactctacgaacgctataataccaagctgtcgcagtatcattttgttgtatgtgaaaagatagacctcggttatgacactatacataatgatgtggagcgtatctataacgatgacaaccacctttattatgtaaactcatggaagcataatcgtacctttacaaagttctgtagtagattgaagcgactggtaggttttgacgtgtatgataatgtatgtgaagacgttcttgatgatagcgtttctgtagaagcgtgcatcgaaaagtattgctcttcgcttgcatacgatgaaaagttccgcgcttatctcagattgttggatttgaccatcaacgttgagccagaggaagaagaacctatcgaaacagaaaacgattactatagcaatgctacgaatgaaccaacagattctgctactgaagcaactacagagacatcaacagaaaatcagcatgttgacgatacggaaactatttgcgaggatgacaagcctgatgcaccaaataaagatgtaacgtcaagacctgttaacgaacttgaagttggggaagaagcagagacatcaccaaaagaacctattcaaaccgcatcgcagcagccaacttctgactctcgtccacaacagcagtcgcaacaaactgaatcaccagttggtcaaacaacgtcatctacagcagaggaagagtcagaagatgacctaggtcagtatgacacatatgaacaggttgatgaagaggatattgaagactacgatgacacagatgaaacagacgatgtagaagctgacgttgatgaagatgttgacacaacggataataccagcacaacgtcttctaatactcatacgtctaacacgtctcacgcttcatcaaacaagcctcataaggattatgatcctgaccgtaatgggtacatgggatctgttgataaggacaagaattatcaacctgttggcgacagaccttacaaacctcgtacacgtaagcatccgaagatcttcaccaaaaaggaattagaacgccttcgctcacatggaacgcctcttgaactggaatcattaccaccaacgagggaggaaatagatctcttagctcaatgtaacatcaaaccagagcagattgccgacaccaactatcttgctcagttgcgtctgtaccagaacctcagaaatgagatgcacgcagaacctgaggaaacaatggaagagttcgtgcgtaatgcgagtgatgtaactgtacacaaacttaaagatggcagatacattcatacttgtagtgctgctcgtggcgtgatgtatgtttctccttctgtatggaataagatggttgatgacaagtggaagatttgcgtttatcttgatggacaaggcaagaacttccattacattaacaacgccgaggaattcctgaaactcgtagaaaaagacgatgttgttatcaagattaccggcaaggagaaggttgatgtagtaagggctctttatacaggcatacttgaagatgccaaaggtactgcatacaccttgattcgtgtggctgctcgtacaaatatggatgctgtattcgctcactatgttggtgctatggcagaatcggaagatggtaacgatgattacaacgataacgactattgattatgattgacaatatcaaacttgcaaactataagtcattctttgctgaccaggtgaaggaggctatcgacgagcaacaaaagatcaatcgctcgcagatgcggaacttattcaagacaggtgaattgtcgcttgcttatgttgattccattcagcatgagacaggcatgattatcctcaaatgccctcgtcgtatggctccacgcttgaaagttctgaagggcgtgtgcataattaagaaaggtgctaagcaagcattaggtgaacacgttacggagtggatctgccgttgggaggagttcgttgacaataaggattttcattctcctggttctgacatgactccaatgtactatgttcatactggtgattccaactatgactatgttgcatgctctggattcagttttaagttgtacgatatcttgtcaaaggcgttggctgatggcaaaagtctttcacttatcgtccataatccatttcctcctgtagagtatttccgcaaccttgccagctacatggatgcattcttttcaaacgaggaattgaaccttgaaccgactatagattatgaggaatggacacccgaggaacttgcgtttgatgaacagaagccaacaggcatttctgacacaatcatagacacgctcgctaatgaacattgttgtatcgtacaaggtcctccgggaactggtaagagttacaccatcgcttctgtgatttcatcgtatcttgatgctggcaaaaccgtctgcgtcaccaccatggcgaacaagggccttatcgagttgataaagcagaagcctttgcagaagtatgtgaagggaggtcgtgtcagcaagacaaatctctctattgacgaacgcaaacaggtgtctggtgtaaaagctgcctctgccgacttgcaggttcctggtggcgaaatgctctgtgcgacaaactatcagttgtcaagcgtttttagcgaaaagaagatgactctgaatggtttgccacaatacgatttggtagtcatagaagaagcttctcaggcttttctcacggctatagttgcgtttaagcagttaggggttgattgcctaattgtaggtgatcctatgcagttgccacctatcgtgaaacttaacaatccacaatataattcgtggaatgtggcaacacaagttgaaggattgaagtctatggcgctggggacatcaataaaatcttatcgtatagtaaccactttccgtctcacgagtcgatctgcctcccttacaaaatgcttttacgggaatcgttttgtgtctgtgaagaaagactatttagattttaccaaagcgaatagtgtcttatttccacaagatggcggtgtactttaccattgtacactagatgtccgcaatggagtttattcagataaagcagatgctattatacgagatgtgattgaaaagctggaaaaattttatcctgatcgttctttagctatcataacaccttttagagattctgtaaaggaactgcagaaacgtttctgtacgtctgaccttgaactggatataactatcgaaacgatagatagaatccaaggcatgactgttgattatgctattctatacattcctggaaggaatccgggtttcgcactagaagatcgacgttttaatgtagcaacaagccgttcgcttagtacgactctcattatttcagatatgcctcttaacgaatttcacactgtctcacctacagtattacagtttatagataactgtgataagtttgatggtaaaacagatgtatggagaactaatttgcaagagtcagaatcatcaggccctatagtccaacctatatctgaagaaaaaacagcatcaatggtctcctccacaatagggttgaaagttgtaggcaaaattgacctctctcaatttgaacggaaaaagaaggaattaagtatgacgaagaaaaactattatatcattgatactaatgtttttgtggactatcccgatattatttctaagattgacagaaagtatcctatcatcttgtctgcaaaggtgacggatgagctcgataagatgaaaatcaaattaactgaagaacgaagacaaaacgcggagaaggctttacgcaatcttaataatgagtcacagcatgagattttatacgagttcgcagatacttctttattgccagatgactttgataaacgttcacctgacaatatgatattatcagtcgcattaaagtataaagaacagaatccaattatgcttacatcagacaatgggctacaacttaagtctaagctattgggtataactacaatctcgcttaagaaatttctaaaaaataatttacgctaagtatagaaagcgacattgatttcctattctgtaagccatctgcatctttcatgtgggtggctttctgtttctatacatttttatcttcacaaccttatgattcgatgatgattcccttatgtcgagaggcataaacgaaaaaatctaataatggaatttgtcattatatccactgataatcagtgcatatagtttatgattcttatgacctgctgatgtttctttatgtgatatttgccatccataaatcagtattgaaatttgccattactttgcagcaaaatcaactgataacgatatggaagacatgaacattacatttgaagatttgcctaaggcaatgtcatggatgatggacaagctcaataaacttgattccaagattgacggtctgaacaacatcccacaagtacggcctgccgaccagtggatgaacctgaaagaactgtgcgaatacctacccagccatccggcggaacagaccgtttacggatggacgagttgccaccagattccgtttcataagagagggaagcgtatcatgtttctcaaatcggagattgacgcatggcttcatgacggcaaacggaaatcgcagaaggaactggcggatgaagccgcccaattcatcaacgccaaacgaaacagaccgttctaatggattcacttgacttgtgcaacagcatcagaatggagttcgagggtatcatagagaacaagatacctttggatgtatttcctgccaagttgcaggacatggttctggcattggcacggcaagagaactattccattgagtacacgatggcatcccttattgcggcagcatcaacggctatcggcaatgcgatcaacatccgcatccgtggcggctgggttagcagtccaattctatacatgatattggtcggacgaccaggtatgggtaagactcctccacttgactttgctttccgtcccattcgtaaacgtgacgctaaagtcattaagcaattcaagatagatatggaaaactacaattccatactggaaagtcagaagggcaagaaagatgaaaggccgtcattgccgcccaagccgattttgaagcggacaatcatttcggacttcacccctgaagctcttattcgtgcgcttaacgacaatccaagaggtgtggctgtgtatgtggatgaaataatgggtatgttcaatgccgtgaatcagtacagcaaggggcaactgatagaacagctcttgactgctttcagtggtaagcctcttgatgtgtcaagatgcagtatgcctgtacccatccacatcgagcggccatttataaacatcgtaggcacgatgcagactacccgtgtgcatgaactggtcgataaggggtacaaggacaatggactgttggatagaattatcttcgtttatccctcgttgcagaaaatatcagactggccgattgacgaagatttcacagcttcatcgtttgagaagtattctgccttgtgggaagatgtaatcaatcgtatttgcgagatttgttttataacggatgagaacaacgactacgcattacagaacgtattgaacttttctccagaggctggtacctattttaccaactggcgcaatggcctaattcataaggtaaaccaaataaaggatgacggcttggttgacagtcgggtaatgaaaatacccatgattgctgcacggttggctttggtctttcagatactccgatgggcttgtggcgaagtacacaaggatttcgtggatatagattccattaagtcggccatcagattaagttcctattttgaagactgttattcaaacatacaaagattcatgttgatggagagtatagaaccgcaaaagaaagaattgcttgacaacgtacctgccttgttttccaccgccgaagccatccaagcgggaaaagaagtcggtctgtccgagaggtctgtgatgtatatgttggtcaaccttacagcgaacaaggttatcaggaaaatcaagagaggagaatatgagaaactgcaatgagctacagggtttgcaccttgcagtatttgcagtttgcagttcagaggatatgggtaacctgcaacaactgcaaactgcatgaactgcatttataaaataaggaggaagtatgatggagtacagatttacacttcaaaaatacaagcgaggttcgaagctgacttgtcctaaatgcggaaggaagcaatgctttgtcaaatatgttgataccgaaggacagattgtgtttcctgattatgtaggcaggtgcgaccatgaacattcgtgccaataccattacaagccatcggattatttcaaagataatcccgttgtattggaagaaaggaagtcgtggaagtcacaaacaaaaattgtgcatcccaaaccaacagattacattgaccgtgacattatgcgccgctcgcttgccaactacggacggaatccgttattcatttttctttcgggtgtatttggtgagaaagaaacatcccgactgttccaattatactgtgtcgggacatccaagaaatggggaggctccacggtgttctggcagattgaccgacaaggaagagtgcgggccggaaagattatgctgtataatccggtgaccgggtatcgggcgaaagaaccgagaagttatgtgagttgggtgcatacggaactggggcttgaccacttcaacatgaagcaatgcttgtttggcgaacatcttttagctggctatccaacaaaagctgtagccattgtggagagtgagaaatctgctttagtggccagccacttcatgcctgattttgtatggttggcaactggaggaatacacggctgtttcaaggctgacaccgttggcgtattaaagaaccgttccgtaattctttgccctgatctgggagcgaagaaggtttggcaggagaaagcgcagttgctctcttccgtttgctcaaaagtggttttcagtgataaactggagcaatgtgctacaagcgaacagagggaaaagggattagatatagctgattttctgttgatggcggacactcccatgatgacgcttcaaaagatgataaagcgatgtccgagtttgcaaacactcattgaccaatttcagttagagttagttgaacaataaataaaaatgaagatgaagaaagacgtttattattgtatagtgctttccgatagtcagcttgattttctggcaggaagcaagtacggtatcgaccgcatgaaggtattgaaatgcctcattgacgctgtggtcattaaggaaacgaagtacgagaagaaaggctttgccattatatcgcatatcgggcaagccgtcctttcggaagtggaattggccactcgtttaggctatgacaagaagaccgtttcaaggctgcttgataaaatggccgagttggggattgtcacatccgaacagaccaaccgcacaagtatacacaccgtgcattgtgtgtcggcatggtatgcagacaatcaaaagatactcaatccgtattacgtgagcatgaaagaacggtataacagcgttggcgaaattggcgacaatggcatagataaagatggtatcgctgccaatacgccaaatgatagaattggaaagtcggacacctccgcctgttgtaacagtggacagccgcctttatcccttatttcggacaataatgttcatgacggagacggagtgtgaaacatgataaaactgagactgttgcgaaatgccgtgtattggctttcaaaagatggctttttacaatgcgaaacatagccttttacactacagttcgtgacgttttggaatagcatttggtttgtgtcgggagttgaggtaatcattatgatgcggttgaaagcagttttttgaggaatggatgtggcggagtacgtttgtcttagacgttataaagactttggacaaaccatctgttctgtgagctgtgatatatccaaagttcatgtcaggactgttacaagaattgcctatgtcgcacaaaaccgctccgcgcttccatgccacataagccgttacagccgctcgcaagctcgcactgggctgaccagttttattttatcgttataaatcattagatatgtcaacaacggaagaaaacaaggacgaaaagaaagaggctataaagcgtacaaagcggctggaggccagagtgaccaaaaaagaatacgcaaaagccgtggaacttgccgagacctgcggcttgactttgagcgactatatccgtaaatgcgccttggggcagcatccgaggcggcggcttaccaacaaagaggtggaagccctttgcagtctctccgatgcacggggcgaactaatacgaatagcggcagccgtcaagtccatacagggcagccatcggatgcaatacttcgcagacacccgtttcgtagaacagtggatgcgtgccgccgttccccttatagcccgttggaatgaaattcaggaatacatcacccaataaatacccaaccagatgatagcaaaagcggccaccatcagccacggcggaaatgccgtccgctattcggtcaacaaggataaggcggagatagtgaaagtgaactttttgcccgatgatatatcggctgaagccgtgtatcagcgcatggtactcaaacaaaaagaatttgccagtacaatcaacaaaggcagaccgctcaaacggaatgtgataagaatggaaatatccccaactaaggaagaatccgcaggctggacgctggctgattggataaggttggcaaacgagtacatccaagtattcgattccatcgacctatcgaaaaaggccaaacgcgccagtgcgaagtccaccaacgtgaagaacagtcagtatgtagttgcactccaccatgatgcgaaaagtggcatacctcatttacacatagacgtgaaccgtgtggacatggacggaaaagtcaacgatgaccacttgatagcggaacgggcaatgtcggctgcgtacatcatcaatgaacggcgaggatgggtacagccagaggacatctacgagaagcgcaggaaggagatagccgacatttgcatgaatgtactctgtgctttgccgaaattcagttggccaggctacgaggccggactgaaagcgcacggctacggcatacacttacaaaaggatgacaaggggaatgtacgaggttattttatcctgtcgggcaactccagttataaatcttccgttctcggcaaaggccgacacctcatgccttcaaaaatagaagcgacatgggcaaggcttcatggagagcagaaatcttcggcaatctcaaataataccgaacagggaatacggccagctatcgtttcgactgaaatgccacagatcaatcgtccggatccagttatcaaatactacgacatttccacggatgaataccaccattatcatgtgactatatcggaagatgcggacgaaatcatccgcaaggaatgttccgtgtcggaggataatccctttgcgactatagaagatgtacagaaaactgccttgcttcttttcgcagaatgccttgacggtgcaacgagcatggcggcatccagtggcggcggaggttctgacatgagcggttggggaaaagataaagatgaggacgaacgtgaatgggcaaggcgatgtgctcaaatggctaatcacttttgcaagcgcaggagaggtttacacagataattgtatcactcaaaatcaatgaatatgggaataggaaagggaaaatccgataaaatagacattgacggccttatagaaagttccgacaatgagggtaagatattgcaggtagaacgcagccttactgaaaatatagcagaactgaaacagacaaccgccgcactcaatgccgctattgaccgtatggaaagcatcatttcaaaattcaactcatctgttcaagaaatgcagacaaagaaaatcggtgcgcaagtgcatcctcaaaccctaaaatctttgaacaacatttgtacgaactttgtagtggaagtcggtcggcaacttatggcttatcgtgacaaacaacttgagcagcaagaagaacacgagaaacggatagcttgtatgcttgaaaaaagcaaaggaatatggctgtcggacaagtgggtgaaaatcctgtttatctgcttccttttgtataatgttcttgtcatactctatgtgcatttcaagacataaaaatcctatactccattttgataaatgataatttagagaaaatggcgaagcaactttacgattattggttcgtgcagttcgactttccagatgagaacggacggccttataagtcaagtggcggtgctatggtatggaatgaaaaattgaaacgagaaatacctaaacagtggaatgatggcattctctcagacattgctaatatcactatgggacaatcgcctgaaggttcgtcttataacaaagtgggagaaggaatcattttttatcaaggcagcacagattttggcataaggtttcccgacattcgacaatatacaactgctccaagccgctatgcgaataaaggtgatattcttatgagtgttagagctcctgtcggagctttgaatatagcaaataatgattgttgcataggtcgtggcttgtcggcattatcttcaaaagtaggttctatgactcatctgtattatacgatgaactactttagactaagatttgaagatatgaactcagcaggtacaacttttggttcgataacaaaggatgaattatatggtttacccattatactaccagcccatgatgtattattgtcgtttgagaagatatgcgctccgatatatgataagcagatggaaataggagaggaaaccgaatcgcttactaagcagcgcgatgaacttctacctctcctaatgaacggtcagacatcggtaaattatcatttatcgtattcgtttgcagccatttctatattatataggcataaactttatgatataaaaaatgaaaagagcagttatacacaccgtagtggatggaatggcacccgttttatccaaagaacagcttaatttgctggaaaccatactcacgcaaacattagatggttatgaggttacacattctatcagtgaagaagaacaacaagcaaaagccaatgcagaactcttgcaagcgtatctatcggcaaagaaaatagagggttgctctgaaaagacaatcagctactaccaatctaccattgacaccctctttgctgctgtttgcaagcccgtatgcgatgtcacgaccaacgacattcgcaactatctatccgactatcaagagcaacgaaaagtcagtcgggtaaccattgacaatatgcggcgcatcttttcatcattcttcgcatggcttgaagatgaagattttattgtgaaaagccccgtgcgccgtattcatcgggtgcgcacggaaagccttgtgaaagaggtactgactgatgaaaatatggaggtgctacgagatagttgccaagaaatccgtgacattgccatgattgatttgcttgccagcacaggtatgcgtgtgggcgaattggtcaacctcaatcgtgaagatattgatttccatgagcgacaatgtgtggtgttcggcaagggaaataaagagcgtgaagtgtactttaatgcccgtactaaaatccacttacagaactatttgaatagtcgcacggacaataatccagcattgtttgtatcgctcttaaatccccattctcggctttcgattagtggcgtggaagtgcgtttgcgaacacttggtcgtaaagtgaatatagccaaagtgcatcctcacaagtttaggcgcacattggcaactatggccattgacaaaggaatgcccatagagcaagtacaacggttgctcggtcacgtcaagattgacaccaccttgcactatgcgatggtcaatcagaataatgtgaaaatggctcacaggaaatatatagggtaacattcttgaatattagccaaatccactacctttgcataaaaatagatttaggtatgatattggctgatattgcagagtatgtgacagataaaattagtagtaacgatgtttcgttaaacaactatgttactacagactctttattacaaaataagagaggcagagaatgtgcgcagaatttgcctccaatgccttgtgcccttattcattttcagcctaaggatattttaatagccaatattcgtccctatttgaaaaagatttggtttgccgatattgaaggaggatgttcgtctgacgtgcttgtctttagagcaaaagaaggacatttcccaaactttttatatgcgacattgatgcaagactcattttatgactatgtaatgaaaggtgtgaaaggaagcaaaatgccacgtggcgacaaggagcaaataatgcgatataaaatgccgacattctcttctgatgaagaacagaatatcggcaaaatagttgttgatatagaaaagaaacttcaacttagtcgtgcgctaaatgataatttagagaagatggcaaaacaactctacgactattggttcgtgcagtttgacttccccgatgataacggacgaccctataagttaagtggtggagtaatggtttggaatgaaaaattaaaacgcgaaattccaaatggatggtattgtggtacgttgttggatatagccgaatacactaatggtttagcttgtcaaagattcagaccgatagatgataataaactacctgttattaagataaaggaaatgcatgatggcttaccctctgaaacagagttggtaaggtcagatattccggaatctgttaaagtctatgatggtgatgttctgttctcatggtctgcatcattagaggttatgttatgggcttatggcaatggcggacttaatcaacatatctttaaggtaacatcgaaaaatggattccctcgctcgttttacttttatcagctaatagactatatcggaaattttaagcgaatggcggaagcccgaaagacaacaatgggacatataacccaagaccatttgaaacaaagcaccattgcattgcctcaaaatattgatattgcaaatgagttagaaaaaaggttatgtccaatctttgatacaatagtaaggaataaccaagagattatgaacttgactaagcagcgtgacgagctcctacctctcctaatgaacggtcaagcatcggtaaattatcatttatcgcatggttaagagcaattttttgatgcaaattttcccaaatatctgcgatgtttctttgaacttcaatatctggaaatatgaacgtaatagatgctatatccgatggattgatagagggatatgcggaaactgccgtatccgcaatgttaccaacgtattcagttattgagggttgagtgagtaaaagatacaaatatcttgcatctatttctttttcatacttttcttttatgtcaatagttacaaaccctgttgacacaatgagattgtttttgggggaacgaagtataccgtaatgtcttaaacgaggtctgacggttgaatatataatagttttatcggtaactttgcgctgagcacgactgggagcatcgctaatattcaaaattgatgttcctgaaattacattttctgtaatactgcttgtatcaagatattctatagtagaaaacgtgtcgtccttgcctatacaaattttattgaagtctgcaatttttccaagtttatattttctcgattccatctttatttctcctcgttttctaattcttcgttattcaaaagatactcatattccgttcctttcaaactttcagggtcatactctttccgataatccaatatgtatgaatgtattatgccgggataggtatagaaatagtggcggcatacgtgcttgaacagttgtagcatacgttcattgccaagaaagctgaacatataatcaagcagaagctctacttcgttttgcgtagctttgcgacggcagatgtcgttcaccaacggtgtgtagtcaaccaccgccatatcagcaagcccttgtatctgctcggcaatcccttttatgctttccaataagcagtcataaccatcaatgttgtcattgctattctttgtattcattgtctgtcctgctttaaaattcccatttcaaatcggtaattgtaattaccgatttggagcggatgatagttattcgtcattttcctagcatattattgacttccttgtcaaagtcggaatctatgcgttgtgtacgattgaatatgtcgtactcactttctgcttttgcttttgcttgcgctgaggatatacgccctttgtcaggcaagattttataatcattgaacgtcagaaacttgtttacgcttgcggcgaattgctccatagtgaaagggttttgacgctcaatttgattttctatatagtcaaaataagaagttaccgtgcgctccagttgtcggatttgtttttcgtccaaataatttttcgcaattgatacatccgatttgagtattcgtcctttgggagagttcttccacgtggtcagccccatgtgttctttggtatggtctgccttggtgtagatgatttctgctgccgtctgtccggtaattgcatagtggaagcggttttgcaccattgcgtaaaaatcctttgttgtcggagagttacggtcatagtctgtactgcattcggcataaatgtccgtaatctgttgccagatgcgccgttcactcgcacgaattgaacgtactctttcaagcaactcgcggaaatagtctttgccgaacacggccgttccttgcttcagtctgtcatcatccaatacgaaacctttacgaatatattcattcagtatctttgttgcccattggcgaaaacgagtggctttcagcgaattgacacggtagccaactgcaataatggcatcaagcgaataaaaggttgttgagtaattcttgttgtctgcggcagttgtttccattttggaaataactgcatccatctgaagttctccttcctcaaagatatttttcagatgtttgctgattgctgggactccaaccccaaatagttgagccattgccttttgggtacaccaaatcgtatcgtctttgatgatgacctgcactttgcccttttcttcgggcatattgtaaagtagaaattgtatttcgtttgccatgatgcttattctttaatgttattgaactgcaggctgtcaagttgcctcattatctctgcttccaatcggcggctttcagcaaattgttcggcaagcgtccgtttatactcatccatccgggcattaaattcctcctccgttatatccacatagtcaatcttgatgtcgaaatactgccctgctgaaagactgtaacctttctccttgatttcatcataggttactgctaccgagaaatcgtctacggcctccttgttttggaatgtattgactattcggtctatctcaaaatcgcggagacgacgtttttgattgttcccttctttatactcctcacctaatttactggcatcaatcaagatgaccttgtcgtgattggccgacttatcgaaaaagattaccgatacgttggttccagttgtagcgaatacattactcggcatggaaaccacgccatacacccatcgctcgtccactactcgctgtaagatacgcttctccacaccgctcttggctgtgatgaaaccagttggaatgacaatggcagccttacctgttggctttaaggaattaagcacatgctgtatgaaacaagtatagatagccatctttggtttcatcgggtcaacctttttcaccgcattgggcactcccgcccaaaagcggatggtatcggatgccaatgtgtcgcgatactcagggaaatcgagcttgaaaggtggattggaaactatgaagtcgaacttgcgtaacacgccgttactttccttatgcgatggttcggtgagcgtattgccttgcacgacattgggaagcgaggctgcaaagttgttaagaatcaaattcaagcgaagcatttccgaagacttctccgaaatgtcttgcgagaaaatagtgcagcgttcttcgcctatttgatgtgccagtgccataagcaatgtgcctgttccagccgaagggtcataacaggtcacgccgcgcaagtcggtgttttcgccgactaacaggcgtgccatcacttgtgcaatggcacgtggcgtgtagtattcagcgtattttccgcctcctgcgttgttgaacccctttagcagatgttcgaaaatgtgtgagaagaaatcgtatttctcgtcaaaaacatcttcaaagttgaatgaagccacattgcgcatcagcgacttggcaaactcgtcacgtttctgcgtatcggtgacgtaggttgtcagcggaaagaagatgttgactttgctcttgcctgatgtggtgacagagaatgtctcggcattgagcgaagcaatatctaccaatgtagcatcgagcaaagtggagaaatcgccctttgtagcagagttatagaggtgcgacaacgtatgttctggcttcaagcgtggcacggaatgtggcagatagctaaacaaatcttccacttcctcttcggtgaatgtgtcatactcggcatcccacttttccgcttttgacaaacgttccccatgcatcggatcacgcttggcttcatagccaaacttgtcattgaagaacttatagaggaacatttctgtcacaatcttgtactcacttcctgttcctgccaatccgaaagctccagtggtgcttttaagagaatcgataagggctattgtagcctctgatatgttgatattacccatatacttaataagcgtagttgcgttgttgtaaatactctgttgtgatcaagttactcagatacttgcgatctttgatgtctgcccgtatcttcattgctattagttccttgcctatgatagacagtacatcctgaccaaaagctggttcgttgtcaagaatgttgatgtcaaggaacagccgtctatcaatctcgtctttcatctttgctaggttctcagcaatctcgtattcgtgtgccgatatgatgggacgttcacgtttttggttctgctcctcaatgcgcttatgaatacggacaaaccgttcatcccccttatacttgcgtttaaggatgttgttgcggcgattgatttcgcgtattttcttcatcacctcgtccatatattgaatgcttgccttggcatcctcggtgctttgcggcacaaatcctttcttgcggaaatattcacggaactcatcggcaaggataacgtatcgttcttctttagtatcgaaattcgcctcaaactctacctgtacccgctcgcaacgttcccgaatgtcattgacaacaattcgcaactcttcgggtattcctttcttgaattcaaattctaataccgaaagagccacattgataatgccggaaacatcagccttatgctcagtactttcaaaaagattgatgcgttcaatgcggtgtgttacctctgtgataagggagggtattcttcccatagggagcgaagcaagtttctctttggtttcttcatcgccaaaagaacgcacttgattgatgattgctttggcatcggagagcgtgttgcgtaactcatacagactatccttattctctatctcgtctatttgcttgcggaactcctccacattgtcaacagtgaaattgaaaagcacactctttatttcttttatcttggtttctacatcttctttgctaaccaaaatgtcattggcaatattttcggtgtgcgtgttatccgattcatccgaagtgcggtttagttctcgcagataacggtcattggttgcatcaaagttttctttgatgtctacaaagtccacgacatagccatatttgaaatcatgataagggcggtttacccttgtaagggcttgcagtaaatcatgtccatcgagagagcggcccaaatacaatttcttcaaacgtggcgcgtcaaagccagtaagaagcatcttgttgacaatgaggatatctatctcttgcaacttcttgaaaccttcgatatactccttgcgttcctgcttatcgccctcgtcatgcagaatgagcgatgctgtaagtggtttgtagttcccatattggagcatcagttctgccgccatatacatttgttgctcttggtatttactaaccttacttgcaatgttgaagcgttccagccaaagacggtatagctctcttgcttgtggatttgttcgacatactatcattgcgcccactgtttcatcattttgttcttttcggaagcggcggaagtcagatatgatataatccaacagagcattcaggtagctttcgtgttccatgatttgattacggtcgatgtcggacttcttaacttccacattaccggccagctggtcgaggatgttttcaatcttctccttatagacagtttcgacaggttcgcgcatcagcttgcaggtgtagccatcagcaatggacttgtcgtaatagtaagtgtggatatagttgccaaacacgcgccacgattcacgttcttcttttagcaacggcgtccctgtcaatgcaattttgactgcgctttggtctgcttccaaaaggtttgccaagaaactgccttgtgggttataccctcggtgcgcttcatcaacgaagaagatacgctgtagattggtgctgtaactatcatcaaccatcaccttggttttgtcctctttgaacttttggatatttactaccatgatttcaggctttccctcatcattgcctgttacttccctatttgctatgtcatccatcagctccttgcggctcttggcgttgtggactacaagcccacgggcggcaaattcatccgtagcttgttccatcaagtcgatacggtcaactatgaaatagaactttgccaccacattacgctgtgcaaaatagtcagttagacttttcacgctgtaatatgcgagtgcagtctttccgctgccttgcgtatgccaaatgataccgcttttcacacctcttgtcaaggcgttgcggatggcatacgaagcaaacaactgctgatatcgcattacatgtttttgtaattgagtaccctgtgtaccatcatccaattcgattttgcgttccacgtatgcgaacccataacgtagcaagaataaaaatctctccttgctcaacatggaagtaatgatgcggtttgtcggtgtagttgcagatttattggtttggtattcttgcaggttcttaatgactatgcagttgcgatgtttcagcaccttattctccatttcatcagtgatttcccgataaggataatctaatacataccgtttgtcctcctcacggaacacgttgaaaaatgccttctctttagccgtgcagcaataaaatgctccttgtataggcacacgactatcggtgtcatactcttggttgttggagaaaatcatcagttgggtgatgttgaagaagcggcggaagcacgacttgctcattcgcttgttgatgcgctccctttccgccaaaataccttcacggttgttcggcttcttgacttcaatgaaagcaagaggaagaccatttacaaaacaggtgatgtcgggacgaaactcatcttctgtatcttcattctcacaagtaaattccgtagttacatgccaatcgttgttttcgggattttcaaaatcaataagtttcgtaccgctgtttgctgaaagcaactggtaaaattcacgccctaaatcatcgttattggcaatattcactattttggcatacaatagtgatgcttccgaacctgacaacccgggattaaggcgtttaactgctttcaagaaaacgtcaatcaagatatttgtctttgtgtcataggcacagatgttatccaaataagtatatcccaacttgcatagatggagtgctgccggaacttgtactctggtattttcattaaatttgttattgcccataatcgtacatcttattcaaagttgataatttcgctcacgctaacctccagcaattccgatatacgtttcagtgttgccaaatcaggttgtgtcgtattggtgcaccacttggaaaccgttgtttggttcacgcccaactgttctgccaaccatttgttggttctcttctttttaaccaatacgagctttaattgattcaaatcttccatattgccaatataatgcttttgatgcaaatatagtgattttacacgataaatacatcttgtgatcaaacatttaatgttatataactgatttagagcatagtgagttatggattacgaacaatagaaatgatattttcatcaatctcaatcttatgcttccctgttgttgtgcgcaaattcttcctgatagtatcaatggtggaattgacaaaccattcgcggaatgtctgcataacgaattgagccgtgacatcccggctaatgttatattggaacgcaatgttccaagcgaagttctttagtgagatttgggtaacggctgtgcgtcgtttaatatggatgtttacactaagagcttgccgattggtgacaaaataccgaacacattcgcagatttggaaaatttcttcttcgctaaagtcaaattgcctgaatgtgtttcgggtgtattgcattacggcttgtagcttttcatcttcttccctttctttttgttgaagatactgccgttcctcatgctggtattcataatggaataactccatccgtttcatttgaatattgtcattgccagccatagatatagcagttgctaaattgcaatcatctttagttagtcggtcagattgcgtaggcttgtgacgaaataaagaaggaagagatattatatgtgccgacagagagaggcataaatggtaaatgagttttagagcaacataacaagctaccataataaaagggagaatgcttaactgcacccccaaagtgtcactcacagggaatgatattgtggacgccagaagcaccgttactaattctattgtccaggactggaatatatgttgcctttgcttcataactatttttatctatggttgttttgcaaaggtataacgtatttccgtaaaaaacgaaagccataaataagcagcaaagatgcaataacttcattttatggcgtttgtgcaaacaagaacataacaagagaaaataccgatgagaaaatgaaaacatctgcaaataagaaatagatagttaaataaatataaatccttctttgcctacataaagctatgtttctccttatgctttttgtatgtcgcttacaaaactgtccttatttgtaccataaaactacaagttgctgatatttaatatatataatatttgaggaagtgaaatgattccgataaggaactaatttataataaattaataagacaaaagcgtgcagctcaataagctgcacgcttttgtacttttgtatttgggggattcatggttgttatcttacaaagaaccaaatctgctaaaagaacggctgtttctgattcatttttttgtgcatctttgggcttccatgctacaacgaaccgtacagatgcggatttcaccttataacctctttcttcccactctgataatgtgtcttgcatttttaatgataaccttgctacaggtttattagttgatgaactatacaaaaagaaatcattataattcaaagaatccccacctcttaatgctaaaacttcctgcttacgttctttgaagaatcctagatagacatctttatgtgagagctgtagtacgatttcttcgggcatgtcatactgtcgttggtcgacaaaatatcgatctgtacttaaacgattaaagcagtcaccgttcgtatgtataaacagccggtttttcgcacgagttattcctacatagtatttgcgcatcagataggcatcttttgaataattatcagatactagtatatacacgtcgtcaaactctctacccttggctttatgaatggttgataccactacttctgctcctgaaacatcacaaaagtcttccaccgatgattcaaatacaaactctttgaagtcacagaggtattttgctttgttggtttgttcaaactgctctacacaacgctttacatacgtcagacttagactaccatcataagcagaaaaggttgcatgtttggcttcctcccataattcttctggaattagaggggtttttgctcgtttgtctatataccgcaagagataccttatttcggccatattccagaagcgcaaaccgtccattgactgtattaatttgctatttatgccatgtttccgcaaaagagccatcaggataacagcctcttcgtttgtttgggtgagtacacacgaagtgcctttgtctttatgttgaagtaatttttcaacgagtggctgatacatatactttgattgatggcgtgttacttcgacccaaccctcttcttttctcatggagataattggcgtactttttattcttttatcaatggttctcaagaatccgttggcaaaattcaccggatggtgtgcactgcggtaattttcggtcatctcgacaaatttacttccgttttcttgtgttagtcggtacatatagtcggaatcagatccacggaattcatagatgttttggtcatcatctcccactgctatcacacgcatttcttcgttgttggccatcaaggcccttaacagtgcatattcttcgactcccatatcctgagcttcgtctatgaccagtaccgtcttgcctattttgtttggctctacttctccttgacagatcatttcggctgcttttgcaacgacactttttgcatcttcaagatttcctatccgccccaaaaggtcgaaacaataggagtggaatgtctttatttcaataaaatgggctgcattgcctatcaactccatgagtctctgtttgaattcagtagccgctgcccttgaaaacgtcaacatcagaagttgctcgtgttttacgtcttcaagtagcagaagtgaggcaagtttgtgaaccaatactcgtgttttcccgctgcctggtccggctgcaaccacaatgcaacgtgaatccttatcggaaataatctccatttgacgtttggatagctgcccgaacaactgcttgtatttttgtggcgtcaagttacgttgtatttcgcttactctgtcccctttgaagtattttgtaacaaacttcctgtaatccatttggaaatagtcttgaacatatcgcagggctgtattgtaatccctaaccatcagattagcatattcgcccacaatatgtacttgctgaatcttctgtttgtagaattcgttgagcatccggtaatcatcctgcttgtatcttgatttgttgtcctttattctttggatattcatggcgttataaagaaccaggaaaccgccttcaagttttagcgcaccaatttttgataagtacagaagtgcttcttccacgtcttccaattgaatgtcatcaagtccgccgaaaagggattgggggcttgattttatttgattcagaagttctactacagaaaattggatagccttattgggtgaatttcccgtttccgtatctgaggcgatcctgtatagccattctatggcgaaacgactaatttccaatcgtttttcaaaacgcttgatggttgattccaagtctgcctgacgacttatttctatattacgaaccgcatcctcttttttgcgggtatagcccttgacagtgaggaaatagagtagtgtccgaatatctttttctttggatgtattgatcccgttgtttactgcattgtcattcagttgcttgcatgatattcgcaaagattcgtcaggaatatggttgaggatatattgttcaagttttgcaaaacgttcgaggagtgtttgcgactttcgttccgagtcacctgcatccagtaaataagcagatatatctttgctgtctgccaatatgccttcttgtcgcattcgttccactacggatataacttctcttttgcttattcccaaaatgtctgccagataatcaatccgcgactctgcttctgaatcttgggctttggcaatgtgtttttgggatatcaatgatttgatgattcggactgccttttctatttcgtcgcggtcgaagagcaatgacattgatatgcgctttcttgcttcatccatattctttaccgtgatgcctgtggcatatacgtgaggcacattatttcctcttatcaagtatccactttgttccaaagctgctaatgctgttcgtacacgggtttcaatatcagataccgaatcgtcccatcctgcctgccgggcaatttccaatgcagaacagctgactttcatacgttgtctggtaaggtcttttatggctttccatacctgttgtatttcactgatgcttagttttgtttggttcaatagtataaaatgcttgtccaaatcattgtcactataaagcacataacaacgcgcgctgaggctgggatcacgaccggctctacctgcttcttgaacgtagttctccagcgaatcggaaatgtcataatgtaccacaagaccgacatcttttttgtcgactcccataccaaatgcagacgtagccacgatgatgtgtacttggtcattcatgaatgcatcttggttggcaattttttcatctgattccattttaccattgaaaggtagtgccttataaccgtcacgagtcaatttggttgccagttcttcagtccgtttggtacgtgatacgtaaatgattgtcggacaattggattcagccacaagttctcttagctttaaatatttatcattgtcactatcggcatgtatgacggaataacgcagatttgttcttgaggctgttgatgcgaataattctaagtctaaattcaatgtttgtttgaaatagtcgcagatgtcttgtactactttttgttttgccgtagccgtaaagcaggatacgggtattggattcttgcattttttcttttgctggtattctcggatgaatttacctatgtagagatagtcaaccctgaaatcctgcccccatgaagaaaagcaatgcgcttcgtctatcacaaatcttacaacgtggcgtgctatcaatattttctcgatagtttttgaacgaagcatttcgggagatatatacaaaagtgaggcttctccgtcttgtactctttgtatggacagtgctcttgtgatggggtctaacattccatttatggtcacggcatccgtgatgcctctgtcggcaaggttgtctacttggtctttcattagtgactgtaagggggagataacaaccgtaagcccgtgtacagaacgtcctgccatgagtgctggtaactggaaggtaagtgatttgcctccaccagtaggaaatatcgccagcaacgatttgccttttaccgcagcttgagctgcttgttcttgcagtggctcgccttcgtatgttcgaaagcgttcatatccgaaaaatacttttaagttatgaagcacgtccagttgcgtattgcagtagtcacagccttcccggcaactggtgtggcgcaggagttttacaataaattccacttccggataattgtaaagtacccatccgggagtgatggaacgataatcagtagtatcaattagagccaatgcgtatgccaatccgcatggatattgttcgatgagcatgtcaaggtcagcatgttggcaaatctttcctgcatacagtttttttataagttcaggtattccttcattgatatactccgcattcattatgcggagaaatccctcaaactcttttttgccctttagtagcgatgcgaatagtatgcgcttttctttcggcaatgaattccagcatgctatttcgtccagtaacaagtcgtttgctttcttgcaatcgttcaccggattgttcatctgttcactaatcagtttgtcatctttcacaagcctatggtaagggcgttccgggaacaataaaggcgagacataaagtgtatcaactaaaatccagcggcatgttttatccgtgaacagatatttggcatcatgatgaatgatattgtgaccgcagatgtagtctatatcacaaagaaaactaaacaattcatctttggaagttttatggaatgtcgtgccatcatgcaggagtgcccctatatcatggattttatgatctttcaagccaacttcaacatctactatggcatagtttggggcactaaatggtacagatgtaattttattaccgatggcattgtttctgtcctcagttttcttgattcctataagtttgctccatattgacatatattcaatataataaattgttttataatttgaatttattatgtatctacatggttttcttattattgttcgagtacaataactcaatatcacatacaaaggtaaggataaaaccgaagaatctgttaaaataaccgctttcttttgatttttatgcgtttacatcccgttgtttatgaatatcatatttttgtgggcaagaactgttgttgcctgtgaatgcttattttcggatttgcgttatatttgcaacacatgtacgcaagtcgctaatagatatatcatgttgattttgaagaggtgaaataaaattgctgaatgactattattctatatcggaaagttcaaaaaaaagtccgtacgtcttttttttagggcgatttgtcgaataaattttctggtaatgaaaatgtagcttatctttggtataacaaaataacatgtaatgggtatgagaacaatttatcttctattatttcccttgtttttgttttttatagtatcctgtactgaagatgaagtagatcctaacttctcgatagagaatgtcggagatgtcgtgatgggttcggctaaaggttcgcaggtaacaatcagttttacgagtacccgtgaatggaaggcgagtacagttgcggattggtttacaatcgctccggtttcgggagaagcgggtacgtgcaatattacgcttactgctatcagtgagaatataacaggaaatgtacgtacggcaacacttacattaacttccgggacattgacacaaaacataatcatagagcaggagtccgcagaatttgtgaatcttgagcagaatatatataatgtatctgttgaaggtggggaattggatattagattctctacgaatatagctgaagatgaattgttgatttatggttctttgggtactggcacttggctgacacaggagacaaaaactcgtgcatcctcttcctacatgcttaacctgactgtattgcctaatactgatggtgtttcccgtactgcctatatctactttgtgaaagtaactgatatggaatcaatcgtagtagagatggttactatcatacaaaggggggaagtggctagtgaatctactgattattcgtcagataaaaaagtacgtgttctgcaaacagcaaagttgggaaaagggcttcctattgtgcttatgggcgatggatttatagatactgaaattaacgatggaacttatgatgcggttatggacaaagcttttgagaatctttttacggaagaacccattaagtcacttcgagattattttaatgtatatgcagtaactgcggtttcgaaacacaatatttttggtacaggatatgaaacagcgcttggttgtgaactggcgggtggaaacagtacggggatttccggtgaagataatgctgtacaacgttatgtacaatgcgtggataatatagatatgagtgaaacattggctgttgtaattctaaattctcctgcgtatgcaggaactacttattttggttatactaatcagacgaaagtggttgagtttgctattgcttattgcccggtgatatacgatttgcaaagtgaaagtttcaggcaggtacttgtacacgaggctgttggacatggttttgccaaattggaagatgagtatgcttatcaggaaaatgggactatttcttctaaagaaataaaaaatgtacagtatctgcagacattaggatgggcgcagaatgttgattttacatccgatccatctcaggtactttggtctgctttcttgaatgataatcggtatgtgtcagaaaaactgggagtatttgaaggggcatgtacttatataaaaggggcgtatcgtccttcggaagagagtatgatgaatagtaataccgaggggtttaatgctccttcccgtaaagcgatatatgataaaataatggaaagaagtttgggtaaacaaatgtcttatgaggagtttgccgtatttgatttacagaataaatcacaaacgcgcagtgctaaaccaactgtaggaccaagtaagccattcacgcgtcctcactttgtaaatagaatgttagataagtaaagcagatgaggctgaacttcaagtttagttttgagttcagcctcatctggactttatatgtaacgtatttattttgaatcagaactttattgcagtatacagcctgtacaaaaacattaaagctgttgtattgggtgtactttacttttgtattccattctggcttagatacaaattacgttaagtacagtatttctctaatcttttcccggttgcctacaatccagacgagatcccctaattggaaagttgtgtctttatccaaggtaatcagttcgtcatttcgttcaatagctacaacaatgctatcatgcttctctcctaaatgagactgagcgatggtctgatttaaaaagcggaattcttcgtctaccgtgaaagagtggagagttatctttttatccactgcatccatatctgatgtattttttacatcttctattctatttctgaattcctgtaattgcgtatctgtaccaactactgtcaatttatcctgcggatagatgtgttcagagcttttcggtatatatatgttcagatcgccacgagtgatcgcgacgacatttactccaaaattttgcctgaatgaaagttctcctaaagacttgccgatgtaatcggaataaggcgatacgaggatagatgtcaagtcaaggtctttatcattgaattcgctattgaaacttgtttttagcgggtgccgttttttagctacctcttcccgtcggttaagattggcaaggaatcttgtttccaatcgtgaatattgcgtgaggtcttccctaagaataagaatcaatgctactacggctatggcaataatcacacttattccccagttgagtttaaaatagctgatgactacactagtgataaagaaaagagcaacagatacacgtcccagaaccagggaaaccaggcgtccgtgattgtaattctcgtctctccatagcttcaggaataattccgaagagttgtatttgttggagatgagcgcccataaaaaaggagtcataagcagaagagtacccagacacatcaccagtttgatccatatagtgataggagtaaacatttcgctgatggcgggataaatgatttgtatcgacagcagccaaatagcagtgagcagtacgctatagatgacaactctcccaatcatgttttttagtaatttcttccagtcactatcgtggttcatggtcttcttgccggaagcataacgatctaatgtctcctgtactttagtaggcaatattttgtaaagccattcggcaaaaggattggctaaacggataaagtaaggagtcgtgaaagtggtaataacagatacagccacaatgataggtgaaataaacggatcaagcactttgagcgaaacacccagtccggcaataatgaaagcaaactctccgatttgtgccaggctgaatccggatttgatggaagtgttcagtggttctccggataagagtacgccaaacgaagagaaaatggctttgccgataatggtaaccagtgtaatgatgatgacaggccaggcgtattctaccaatacagccggattcaccagcataccgaccgaaacgaaaaagatagctccgaagaggtcttttaccggttgtatgatatgttcgatgtgttcggcctcgatggtttcggcaaggatagatcccatgataaatgctcctagtgctgttgaaaaccctgtataagtagccaatactaccattcccagacaaagaccgagagagacaatcagaagagtttcgttattcatcaacttctttgcttttttgagaaaggccggaataacgaagatacctatgagaaaccacaggattaaaaagaaaacaaccttgagcacacttatcagcaaatcttcacccacaaagtcctgactcactgccattgtggaaagaagcaccatcattaagatagcaatcaggtcttccactaccagagtaccgaatacgataccggtaaaacgttggttacgcaattccagatcattgaaggctttgataatgattgtagtggacgacatagacaacattccccccaggaaaatggaattcatagtgccccatcctaataattgtcccaccaaatatccaatgagcaacatactgattacttcggtgatagccgttataaaagctgtggaacctacattcatgagcttcttaaaactaaactccagtccgagtgcaaagagcaggaatataacacctatttctgcccatatattgatattctcaatatctcctactgtagggaaaatattaatataaggacctgccagcaatccggcaataatgtaacctaagactaaaggctgttttagccatttgaacaataaggttatgatactggccgatattaatatcagcgcaaggtcggcaatcaaagttggcaagtgtgacattaggtgtgggtttatttattataacattcctgatagataatatgtttccatctataaaaagatggaaacaatataataaatagctgcagctaagagtccgctgactggaattgtaagaatccaggcagtcatgaggcttttggttactccccaacgaacggcagagaggcgtttagttgcacccactccaataatcgctcctgtgatagtatgtgtagtactaacggggattttcaacatttccgtaatgtagagagtgaaagcacctgctgtttcggcaatcactccttccaatggggttaccttggtaatttttgttcccattgttttcactattttccagccaccggacatcgtaccgagtgaaattgctgtgaagcacgaaaaagcaacccagtcgggaaggtcattgatgctgttgatacccatgcccaatcccattgaatggccggctatcatggcagcggcaataatacccattactttctgtgaatcgttcaagccatgtccgacgctgaagagggcggaggatacgagttgcaacctcttgaaccattgctcggctgtgtggggatgtgcgcgtcggcagatgtagaggacaaacagagtgaaaccgaaagcaatgaccattccgataaaaggagccagaaagataaaggctgcaattttaagaatgatgttaagctgaattgcttcaaatccgtttgccataatggcagctcctgcaaaacctccaataagggtgtgtgaggaagaagacggaatccctttccaccaggtaaccaggttccaggtgatagccgctataactcctgctaatataatgggcagggtgatatattgctctaccacagtcttggatactgtattggcgataccgaatccacctattatatatttggcaatgaaaaaggctacgaaattgaagaaagcagcccatattacagcttgaaagggagtaagcaccctggtagatacgatggtagctattgagtttgctgcatcgtgaaagccgttgatataatcgaatatcagagccagaatgatgatagtcactaataattccatgtgttccggcttgctttatgcgtactttacaatcagatttttgagaatcttgcctacatgctctgcggcatcggtcgttttttccagttcatgcatgatctcctttattttgataagttcaatgcaatccttttcctcttcgaaaagtttggtgataaagaattcatatacatcatccgcctggttctcgatttcatgcagtttggaacagtattcacggagaagagtcggtttcttacggaatgtttcgagttcgtccatggctttgcatatatagatcgcttcctcctgaatcaaacggctcaactctttgccattctctgaaataggacggggattgtaaatagagattcgtttggcacaactgtttattccgtcaatgacgtcatccatgcaggaagctaagtcatgaatatcttcgcggtcgaaaggagtgataaaggtagtacctaattcatcaaaaatcaggtgtgtcagtctgtcgccttcccgttccaggtctttgatttttttgtagtagtccgaacgttctgtaggtgagtcatgttgcaagctttctattaaaacaactgatgcttcgcagagcacttctgatagctgtttcagtaaagggaaaaatttgggctcctttggagtaaaccggctaaaaaaagaatttttcataagtgtaaaaactttaaattgttttttcttctctatttatattagtaacaaatgaatacagattatagtttgctgtttttaagattttagtttggcacgtactacctctataatggcaggcaatacagagataaatatgatggctacaatcagtaacttcaggttttcctgcacaaacggaaggtcgccgaagaaataaccagcataacagaatacggcaacccagagcgcaccaccaactaaattatacatcataaaatagtagtaattcatctttcccattcctgctacgaaaggtgcaaatgtgcgtactatcgggacaaatctggctagaataattgttttcccaccatactttttatagaactcgtgtgttttctccagataactttgtttgaatatcctggagttggggttattaaacagctttcggccgaagaaatgtcctatcatgtaattgcaggaatcgcctaatacggcagcagcaaataagataatgacaagtatatgcacgctgatgggcatatcgggtaatgctgaaatggctcctgcaacgaagagtaaagaatcaccgggaagaaaaggagtgaccactaatccggtttcacagaagatgatagaaaacaagatggcgtatgtccaggcatgataatcacgcacaatcatcaccatatattgatcgatatgaagtataaaatccaataaaaagtccattttatatactttggttattattgtaatgaaagaatgttataggcttccagaccatagtgaattcttttttcactcaaatggtggaggcaaacagaaagtggggcataaaagacttgaattgtcctatgccgaaaaaagatataaaatggctaaatgagtatgtgtcctaatgaatagatatgatatctatcggaatatttaaaaagattggtataatatgaaaaacctgtccattgatttttaggaagttgaatctttagcgagcttagtatgcggatagtgacagaaggaatattgaatcttagtatttttaagggagagaggtggcggaaggaaaatggatttaaaacgccgttatcgttattgtaattttgctttccggcgtattcttttgtcttgactagtttctgttcttgatccagttgtataatgctagctttagaggtatatgaataggaataggaataggtttgtatgccgttactaccggcttctaaccggtatgcctcttgtgcttcgttgaaaatcagatggaatccccaacacagaaatacgcctaatagtatacaaaatatgtacttcatcataacggccgcaaaggtagaaactatttttatatgaaatacatattcacaagcataattaacaattatatcagtgattaccgggaattattctttgaagttgcttatcgtaaatttcatcggagtatatgttatcccattggtacattgtttcttattaattcccggatataacattggaatatgatttctttttcttttttttgtaaaagctgtagggtatttccagtctgagcgctcttataaatagaaacgtaatttatttacctttaaaaagcatcagtatgaagaatgtagaaaaacacttggttggatggctgtcaatttgtttgctgctttgtagctttcctgtgtgggcgcaaggagatgccggagattatctaacaatcgttggtatggtgaaagacaagcaaaataaaaaagctctggagaacgtaaatgtatctgtgcatggcagtaatatcggcactgtgacgaatgcggaaggagaatttgctttgaaaatcaaaaaaacagaagcgccgcgcgaactagagatttcacatataggttatgtaaataatcatatctctctggagaaagaaacaccctctaagttgacggtttggctgacacctcatgccaacctgctgaatgaagtggtggtgtttgctgaaaatccacgtatgattgtagagaaggcaatcagtaagattcctctaaattatagtgataagcgtgatatgctgacgggattttatcgggagactgtacagaaagggcgtcggtatatcggtatatcagaggctgtaattgatgtgtccaaaacagcctacactaatagaaatactaattatgacaaagtaagggtggtgaagggacgtcgcctgcttagccagaaagcgagtgatacattagctgtcaaggttgttggcggccctaacttgagcatcactttggatgttgtgaagaacaagggagcattactcgatatggaagaattgaataattatgagttctggatggcggaatccatgcttatagataaccgtatgcagtatgttattaatttccgcccgaaggtaatccttatgtatgctctcttgtatggcaaattatatatcgatcgtgaacgcttgtcatttacccgtatagagatgagtctggacatgcaggataaatcgaaggcaaccactgccattctatataaaaagcctctcggtttaagattcaagccgcaagagctgtcctacctggtcacttataaagatgtggatggaaaaacttatctgaattacattagcaacacaatccgtttcaaatgtgactggaagaagaaactgttttccacaagctatacagtagcttccgaaatggtcgtgaccgacaagagagaaggaatgttggagactattcccaacaaagaagccttcagcttgaatcaaatattctatgataaagtagacgaatattggagtccggacttttggggaaactacaatatcatcgaacctacggaatctttggagcacgcagtggataaattaaaaaagcaatcgaattgaaacagggatagttttcttatatttgaggtcaatcataaagaaaagcaagtatgctggatgaactgctcatactaaaaaagataaagggaggtgacataaaagcgtttgaggaactctttcgccgttactattttcctctttgctgttatgcggcaggcattaccgggcaaatggaagtggctgaagagattgtggaggaacttttttatgtactttggaaagaaagggagcgcttacagatctttcagtccgttaaaagttacttgtatagagcgactcgtaatcaatctttgcagtattgcgaacacgaggaagttcggaacagataccgtgaaactgtattgactacttccaacccagagcagtcaacagatcctcatcaacagatggagtatgaggaattggagagattcataaatggaacccttgaaaagctgccggttcgcagacggaggattttcgagatgcatcgtctggaagggcggaaatatgtcgagatagcgacgcagctttcgctttctgttaagacagtagaggctgaaatgacaaaagccctccggacattacgagaagaagtagaaatttatattcacatgaagtgatgaaaacagatatttataaaataaagacagatcaggcgtggaatcgattgtataatcgcttggacaatgaccgtttacttgcgaaagtggatgaaggccaccatacacgcaaatattcacaatggatcaggtacggagcagttgccgccgttttgataggcgtcatttggggaactttgtattgggtgaccggttctgataaagaactggcacagcatcttcttacacaggaaaatcaaggtgtttccactttggcaacgactctcgaagacggttctgtcgtactcttggcaaaagaaacttccctgttatatccgaaacattttattgctgataaacgggaagtgagtctacagggaaatgcgttctttgacgtagcaaagaagcagggacaacccttttggattgacacggagcaagctaagattgaagtgctaggtactgcttttagtgtgcaaagtgatgaaaatgctccgttccgtttatccgtacaaagagggatagtgaaggttactctaaaaaaaggaaatcaggagtgttatgtaaaagcgggggaaatggtagtagtgcgatcacaacgattagtcgttttggatacagataacgagaatgaagagtgggggagcttctttaagcatatacgatttaaagatgaatcgttagcgaacattctgaaagtcatgaatttgaattcggatagtttgcaaatacaagttgtctcaccggcattggaggaacgtcggctgactgttgaattctctgacgaatcttctgaagttatagctaatctgatagctaatgcgctcggtctgcaatgtatccggcaaggagatattcttttattatcggaatagaactcattaaagttgggaaaaatgaaacagtcttatcattatctgtccgttctgctgatactcttcttcttcgtcgatatgatgagagcggatggaagtgatgtgctggaacgtatagtcagacttcccaagataaaaggtactgtttattcattgttgagtgatgtctctcaacagtcgggatatatgtttatttatgacagtaaagtcattgataatgatgcagtagtcaagataaagggaggagaacggtctattcgccaagcggtgtacgatatagtgggagataccggtttggagtttcaggtgattggtactcatattctgattactctcccttcggagaaaaagattcatatacaacaggattccattccgaagcagcctgtgaactttgtcattatcggtactttgctggataaggagacaggaatacctatctcttctgctactgtcggagtgcgaggaacatctattggcagtataacgaatcagaatggagattttaaactgtctttacccgattctttgaaaaatgattcgattactttttctcatataggttatctttcacaggatatagagtttgctttgctgattggacggcacaatatacttagtctcgaacctaaagttgtccctttgcaggaagtggtgattcgtcgaagtgatccaaagaaacttttgcgtgaaatgattgagcggcggaataagaactattcgcatactccggtatatctgactactttttatcgtgaaggagttcagttgaaaaacaaatttcaaaacttgtcggaagctgtgtttaaggtttataagacatcctcatattcttctgtaccggatcaggtgaagctgttgaagatgagtcggctaagtaatatagaagcaaaagacagcttgcttgtaaaagtaaaatccggaattcaggcttgtatccagatggatatcatcaaagatatacccgaattcctgactcctagtgtagagaagggtatttatgactatacttcagaaggagtaacatttttagaggaccgatttgtaaatgtggtgcattttgagcagaaaaagggaatcagcgaacctcttttttgtggagagctatttcttgattccgagacaagtgctctattgcaagcccgtctggaagttcatcctgtatatgtgaagaatgcggcaggtatgtttgtcgaaaggcgcacgcgtaacgtgcgaatgattcctcaaaaggtggtatatacaatttcttataaaccgtggcaagggacttattacatacaccatatccgtggagatcttcatttcaaagtgaaacggacaaaaatgctgttcggcagccgggatcttcatatctggtttgagatgattacttgcaaggtggataccgaacaagtagtcgcgtttccccgtacggaaagattgcctacccgtacgatcttctccgacacacatttcaaatatgatgagaacttttggaaagacttcaatgtgatcccattggaagaggaaatcagtaaactgatagaaaagatctctttgaagatagaagaaataggtgattgatttgttttgtcattcaatgagattgctgtacctttgcatccggtttaaaagattgtatgttatggaattaccaaaagatccgatgatgttgttcagcgtcatcaatatgaagttacgcgattgctattcttcacttgacgaactttgtgaagatatgaatgtgaataaggatgaattagtgagtcagttgaaagccgcaggttttgaatatagtgcggaacacaataagttctggtaattatccccttatttacagtttataactagagtatttctactaaaaacatagtgacgctatccggcaaagatagtgacggtatgagacaacgataccgtcactatcccgagtatataccgtcactataattttctaccttcatcaaaacgtcatcaggaatcatgtgtttattcctatcgtatataccgacaatgatttccgcagttctccctctcttgttaataaaagcaaaataccaaatctcatatttaacttcacctgccttccacgttctaactaataaagtttagaaaaagaattgatgataaacgagaataaaattcgtgaagcttgtgcctcgaatcgcgaacggggattcaagatgttgatggactcttttcaggtaccgatatataattatatccgtagactggtcgtatctcatgaagatgcggaggatgtgcttcaggaagtttttatccgggtgttccggcatatcgatcagtttcgcgaagaaagttcactgtcaacctggatttaccggattgccacgaatgagagtttacgcttgctgaacggtcgtaaagatgagggagttgtttctgcagaagatgttcaggaagagttgatgggcaagttgaaggcttccgattatattgattatgaaaatgagctggcagtgaagtttcaggaggccattctaagtttgcctgaaaagcaacggcttgtattcaacttacgttattacgatgaacttgaatatgaagagattgcccgtgtactggatagtaaagtggatacactaaaggtgaattaccattatgcgaaagagaagattaaggaatatatattaaacagatagaatgatgaaaaaggattttgattttgacgatattggtaaacggacaccttaccgtactcctgaaggattcttcgaggatgtgcagcgaaaggtgatggagcgcgccggattgaagcaacagcggaagtctcatacgaagctgattatttctacggtgattaccatagcagccgtatgggtcggatttctgtttgttccgtctttgcgacaggcagatgaggtgacaacatcttcttcgaaagtattagccaatggtacggaaccggtagataaatggattaaagaactatcagatgaggagttggaagagctcgtcagcttctctgaaaatgatatatttttgaattaagtaactcaattaattattttaaacgtgaagattatgaagactaaatttatttatgtaattatggccgttctcctaatgggaagccagatgactttgtctgcacagaatacagataataaacaaaaaaaacagcgtcctacaccagaacaaatggtgcagatgcagactaaacaaatagtaaatacattgatgttggatgatgcaacggcagctaagtttactccggtatacgagaagtatctgaaagaattgcgtgaatgtcgtatgatgactcataaggcgagaacagagaaaactaaagcacaaggcacagacgctaatgctaagaaagaacgtccgtccatgactgacgacgagattgcaaccatgttgcgaaaccagtttactcaaagccgtaaaatgctggatattcgtgaaaagtattacaatgaattcagcaagatactttcgcagaagcagattctgaaaatttatcagcaggaaaagatgaatgctaataaattcagaaaggaatttgatcgcagaaaaggtcagaaaccgggacagggacaccactagggacaaagaaatcgtgctcctcgtcaagccccgaaataaagattaggtttattttattatagttttattttactaaatcaacacaatttgaacataggcagccacatttattcttttcagtaccgtttgattacttgttatgtcttgttactgattagtttgactgtttttgctcagtccggcaaagagcgtttttccggtcgtgtgattgatactgaaaccaatcagccggtaccgtttgctacggtccggcttttggctttaccggatagtacattgttgggcggcggtgctacggatgctatcggtaaatttcaactttccgtttccgttcctactgtgactaaggcgaagtctttattattgcaagtttcatatatcggatataagcctgtttttcatcccatttccatttcccgcaaaagcacctcctatgaattgggaaatatcaatctgactccggaaagttatgctttggatgaggccgtagtagtggggcaggctccaatggcggtgacggaaggggatacaacggtcttcaatgcttccgcctatcgtactcccgaaggttcgatgcttgaagagttggtgaaacagcttccgggaagcgaaatagatgcggacggtaagttattgatacatggtaaggaggtgaagaagattttagtggacggtaaagagtttttctctgatgacccgaaagccgcccttaaaaaccttcccgtggagatggtggagaagttgaaagcctatgaacgtcaatcggatttggcacgtcttacgggaatagatgacggagaggaagagatgattctggacttgtctgtgaaaaaaaatatgaaacggggctggatggagaattttatgggaggatatggaagtaaagaccgttatgaattagccaataccttgaaccgttttcgtgaaaactctcaattaactattatcgggaatctgaataataccaataaccagggattctcggaattacagaatgaatcttccagttcaacaggtaatatccgtaatcggatgggactgactacttcccgttcattgggacttaacgcgacttatgactggaagcgggttaagttacgttctaatgttcaatacgtgggtacagaccgtttggaagacagccgtacaacagtcgacaattttctccgtgaggataaatcaatcaatctgggtaagaacggtagccggttacagaatcatgagttggtagccaatgcttttcttgaatggaagatggattctgttactacattgattttccgtcctcaatatcgtttctcggccaatgacagagagaatagtggctttcaggaagggtgggggaatgatgtgctgttgaatgaaagagagtcctccggcaccaatcataattcccggtataatctgacgatgatgttgcaacttagccggaaattgagttgtttggggagaaatgttgctttgaaggtagactatggtactaatgcttcagctacggatcggacgaatctttctactacccggtacttcaaaaataatacgaagaagattcagaatcagaaaatagaggatgatgttgacgggtataattaccgggtgcaactggtatatgtagaaccattgccgtggcggcatttcctgcaactccgttacagctatcagtatagagtgaacaattcggatcgttttgtttatgactgggataaggaattggaagagtttgctcctgattttgatgaagaatccagtaaccgttttgagaatcaatatagtaatcatttagtaaatcttgcgatacgtacctcgcaaaagaagtacaattataatattggtgttgattttgaacctcaaaagtctgttagccattctttgttgagtgatgctcccgaagatcagttggaaagatcggtcatgaatttttcgcctactgtcaatttccgctataagttttcaaaacgcacccgtttgcaaattgtgtataggggaaaagggaaacagcctaatatacgcgatctccaacctgtgaccgaccgtaccaaccctttgaatattcgtgtcggtaacccttcgttgaagcctgcatatacgaatacttttacgctgaatttcaattcttataataccaaacatcagcgaaatatggtagctaccgctttgttcgagaataccattaacaatgtaaccaaccaggtgacatacgatagtgaaaccggtgtacgaactacatctccggtcaatatgaatggtaattggcgcgccatgggttctttttctcttaatactccttttaagaatcgtaactggatatttcgtacttactcctatctgcaataccggaatcagaatggctatacaaccttgaacaaagaagaaccggtgaaaacttccgtacagcatttaacgggacgtgaacgtctacggattacttatcgtacccgccaaatggaacttacggggcttgttggtctgacttataacaattcttataatgacgtacgggagaaacgtactgaaacttttgattatcaggcaggaactgaattgcagctttatcttccctgggggatggagttatataatgacctgacttatttccttcgtaccggatatggttatgagggttatgctaaagcaaatttcatgtggaactgtcagctgtcaaaagcctttttgaagaggaaacagttactaatccgcttcaaaatatatgatattcttcatcaggacatttctatgatacgtacgataaccgctactgccattcgtgacactgattataatgcactgggttcttactttatggtgcatgctatacttcgtttgaatatgatgggaaaataagtagaaattaaatcttcataagtttgaaaaccacagcagggttttgattgttgtatgtcctacgtataaaaacaatgtaaggctggctgaatgtttcgactgataaaaaagataaaagataaaggtcgttggcgcatttttaaactgaagttgattgatgcccgactgtactttgtcagtatcttcgtaggattactgacaggacttgtggctgtgccttatcattacctattacagtttttctttaatctccgtcacgatttctttgattctcatcccaaatggtattggtacatacctctttttcttttgatgtggggaatactggtattcgtatcctggttggtaaagaaaatgccgcttattaccggtgggggtattccgcaaacacgtggagttatcaacggcagggttgattataaacatccttttctggaattggtggcaaagtttgtaggtggaatacttgcattaagtaccgggttgtctttggggcgtgaaggtccctccgtacaaataggttcgtatattggatatttggtatccaaatgggggagggtgcttagcggtgaacggaaacaactattgtctgccggcgccggtgccgggttagcggctgcttttgctgccccattggcttcatcattgttggtgatcgaatctattgagcggttcgatgcacctaaaacagctattaccactcttttggcaggagtagtggcaggtggagttgccagttggattttcccgatcaatccttattttcatattgatgctattgtaccgggaatgactttctggggacaagtgaaattgtttcttttgttggcagcagtggtttctgtttttggaaagttcttttctgtcaccactcttcaggtgaaacgtatttaccctgctattaagcatccggaatacgtgaagatgttgtatttgctttttatagcttttctgatttctatggccgagtttaatctgaccggaggaggggagcagttcttgttatcacaagctatgcatccggacacgcatattctctggattgtcggcatgatgctgttgcattttgtttttagcgctttttctttttcttcaggtttaccgggaggaagttttattccgacgctggtgacgggaggacttcttggacaaatcgtgggattaattatggttcaacagggtgttattgcttatgagaatattagttatatcatgttgatttgtatgtctgcattccttgtagcagtaatccgtacccctttgacagctattgtactaataaccgagattacggggcatttggaagtcttttatccttctattgttgtaggaggattaacttattattttacggaaatgcttcaaatcaaaccgttcaatgttattttgtatgacgatatgattcattcgcctgcatttaaggaagaaccgcgttacacattgtctgtagaaattatgagcggctcttatttagacgggaaaatagtagatgaacttcgtttaccggagcgttgtgtaataattaatgtgcatcgcgaccggaagaatctacctcctaaggggcagacattaatgcccggcgatcaggtgcaaatagagatggattcgcaggatatagagaaactgtatgaacctttagtcagtatggcgaatatttattaagcatatggttggcagaataaattcataacggtacggaaatgaatgaaacagtgcggatttgaattaaatgctacatggtgaaaaaatatctatcataagtatcattcattttaataatcatttcattatcagaagaataactatgatagataccttttaaaaaaggcatctatcatagttttattgcaaaaaacagctatctatcatgcctatactttgtctattttagtgtagtattaggtgagattacccatttaaaggcataagaatgcacgttttataggatgacaacctgtattcttaataatctattgggagcggtaatgtttctatagcccacgtatgcaggctgtacagcccgcatctgtaggctgtatggtttacaagcgtgggctgtacagcctgcatacgtgggctataaacttatcaccgttaaagttggattatcaagccacgatcatcggatttatacaggttcattgcaataaaaacaagctatcttatgcatatagggcctttattcggctattttgttgatgatagataacctgtttttgctggtaaaagcatgatagataccttttcaaacagctatctatcatacttattcttttgataataaaatgattattaaaatgaatgatacttatgatagatgttttttcactatgtagtatttaatttaaaacagtgcaataatgaattaattccgttaatgggtcgcctctaattaatttgttggcaataccatgactattccatgcttcttagccatgcaatttcttctttccatttactttcatccggagtttcgagtattaacggtatattatcaaatctggaatcttgcatcaatctttcaaaaaaagctttgccaatcaatccttcaccaatgctgtcgtggcggtctacatgggtgcctagtgctttttttgaatcattcaagtgcataccacgaagataattgaatcccacttccttgtcaaattcatcaaatactttatcgtattcattgacaatatcgtaacctgcggtataagtatggcaggtatcgagacaaacacctacccggttcttgtcgtttacccgatcaatgatatatttcaactgccagaattcgcttcctaaattactgccttgtccggcagtgttttcaataacggctgttacaccttttgttttctctaaagcgagattaatgctttctgcgataagtgacagacaatcttctgttgatactttattgagagagctaccggggtggaaatttaaaagtttcaatccaagctgttcgcaacgttgcatttcatccagaaaagcggcacggcttttttgaagtccctcttcctccggatgtcccagattgataagataactgtcatgtggcaggatatattccggttggaaaacatatttctcacaattctctttgaagagactgatactttcttctgttagaggtttacttacccattgacgttgattcttggtgaataacgcaaaagcatttgctcctatttcgtgcgcattaatgggtgcgaactctacgccaccagaggcgctaacatgtgctccgatatatttcattgttctttcttaatttattttactctgcaaatataacgtttttaaaggagtatatgtttgtagagagaactcttcttggttacaattcataggatcatgtactttatactctgttctttatcttttattctctataaaaaatatcccgttattcaattttctataaattgaataacgggacagttttttggggggagagattaaatctcaaaatccggtaaatagtctgtcaggactttattaacctgtttcccttttacctgatctgttaccgtcgttgcaccttcctttttaccggcatcgtagtttaaggaaactttctccactttattactaacgtgaatagcggcttttcctttttccgtaaggttgcaagtgatagtccagtcacctacttgaatgatattgcctttgcgaactacctgcatatccggacggttgtctccatgtgtatccatcacagtcaggaaacgggcggttttgcaaggaacagttgtagaagagaaatgccagtgattaggatatttcactgcttttccttgtgcattcgtcacatttttccagttggtcggagcacagaagaaagtatctaccattgcctgttccgtttttgccgaactgaaaagatgggcaacagagataccgccagctttattccttccggttactttcacctcatcggtcagttcctgtatttccatcggtaattctacagtatgtaaaaggtaactccatgtaacagcctcctttccttccagttcatcataaatcacgaaaactccggtacttcccagttggatgatatgacggcggaacatattcagtttgttctcatcccatcctttttcaggtgtatattgcgtaccggatagttctccacgtttcagccataggggagaagtcactttaccataagcattggaagcatctcctaccatataagcgattttttctccttcataccaacgcggaatccagccatatccttccgttccaatcttttgagtcattccatttaccaaaatgctgttgtgtgcacgggtgttacggtaagaatacatacaatgatcgtccgtaaaacctgtacgatgtccgctgctgtaaaaaatggctttacctccatagaatgtattaaaagcattctgattggccagtgcatgggaagtggaaccataagaactggagcggaacgataacatggcattcttatctatatctcccaaagaggtattcatcgtaccgattcccgtttcattgaatactttcgccatgggtagttcggcaagagtatgtccttctttggggagaactttcttggttgtacaacgataccaggtcaagtctccagattttccgaggaaagttttttccatgatatccggttccttttgcagaatggtacgtacataagcagccgcccacggattattacattcacgtgccaaggcatccgcataacctactcgtgtaccgttcggcttcattttgctttcatgtgaattgccttgtcctgcagattttgagaatggaggctgctggtagatgacgtaaaatgcattgttgttataccacggatcggcgaagaaatcgaatccgctgatacgggagtagaaagcgggaacttcaatcaatgtgcgaagattgacctggaaataagaatcaccattgtgccatcctccatccgcgttgaggcccggcagacgggatacccattcattgtagcaataatccacccaggtggaagccatcgggagttcgccatacgtagcaaatgccgccatattcaagatacggaaagtcatttgccagacatgattatcagcaatgcggttttccaagtgattgacatattcatgatagaacttctttccattgtcacgaatcgttcttaggagtagttttctctcattcggagtcaacagattgtaccatgcatcatacgctgaagtgctcatggacagaatagtagaacgattgaaatctccagcaaagtacttactttttttccaggaaagaatttcggaaagacgcttaatgccttctttgtagtatacctcatctttcgttagcaggtaagcgcgtaccatggcttcgatatttgcttcttcacggtctacaatcttacgactttcccgaatcagggcagaacgatattgaacaatatttgtcaacttgacaacctgggttgtatcaatttcttcttccagatgtttcagcgggtggttcaggcatttatcggcttttcggatataagcctgtgcctccggattgtttttattccgttcgatgatattatcccaatcttcggcatcaagcaagatgcggggatgagtcttgggcaatttggttaatacttcctgtagagaaggagggttgaatgtacgtatgtgttcgtctatataaaaatgataaacaggtgaccattcttcttttccttctttgttaacgtaggcatgttgccaataccatttccctttttcaaagagtttgaatgggttgaaaaatgcccattttctttcggcggtaatcacttccgatttaaattcggggtcgcgtgcaatacggatgcggtaggttacttcgggtttgtagtcctcttcttcaactccgtccaatacagcaccgaggtgcgggaacttatccggccacataaaacgtgggggattgacagtaatatgctgtccgtccagaggcgaaggcgtttcgcggacttcatgcatcaaggtctgttgagtcagacgcatgattcctttttgtgcatatccattggcgaatagcagaagggtgaacaagagaaaaatagatattcgttgtttcatcatataactttgcttttattattcatcgctttgttattcagcgttgtttgaacaaatctttcagacgaacagtcttgttattaatcagtggacatgcccagaaaccgataaaggtgatatatcctacaaaaacaaggataaagagcatacccgtacggagtgatgttgcatctgccagtgtacttacaatcatcggaccaccggcaccacctacaattgccgagcatagtatacctgcgaatgaaccgtggtgctgtgacgcagagttcagcgccaatgagaatacgatggaatacatcatggagatgctgaatccaacagcagggaaagcaagcatggatacttccttacttccgaataatgccgataataataggatgatcgtcagaattccggaaatttgcaacaatcgtttactgtcaattaacttgagcagaatcatacctaccagacaaccggctgtcatcaatccccagaaatagcttacggcctgtgcaccgtctgtttgtgggttaactccatgatattgttccaagaaggtactcatgaagattgaagttccctgttccgtacttacatagcagaaaattcccaggaaaaacagccatacatatttctgtttgaataaagccagatatgaatctttagacccgcttttctcgtcttctttcaactcgatcttgggaaaacgggatacaccgacagctatcagcatgaccaatagcaggattgtaaatacccaataaagagatacccacggcatttcccgtggagtgacatcggccaacaggtcgataaagaaactcttacctgctgtatatgttgccggatcaagttcacgaatcagataagtatataccagaggacttaggaaagaagcaatgccaaacatgaactgtgccagttcggcgataaatgcatagttttcttctcctcctacggtacgttggagtggattcaataccgtttgtaacatggccattcccagtccgatgatgaaagaagaagccaataacatcggatacgtgtgcatgcaggcaaataggatggtgccgataaacggcatcagaaatccaccgaataatatcggcttttcaccgaaacggtcgatgagcaatccggcagggatagacatgatggcataggccaggaagaaagaagtcgggataaatcccgccattgccaggtcacttagattgaagttgtggataatatccggaatgagtgggcctagaatattggtgataaacgagatggtaaaccagaacgccataatcagcgccagcatccctaaattttttctcataatcttaaatagttgatagttgataaatgataactgatagatggaagttgataattaattgatgattgagtatttgtatgttgggataactttcatttactaactatcatttatcagctatcaactatcatttatttttgttttcatttgaaaaagagtgaagcggctccaatacttccggccttgtttccaagagcggcagctatgatttgagtattcacggcacagtcggggatggcgtaactgcgggctttttcgcttactttctgaatataaaagtctccggcttcggaaagtcctccaccgatcacaatcttttgagggctgaagatattaatgaatcctgcaattccatgtcccagaaaatcacagtgttcttccagcgatagttgtgcaatcttatctccttgtttgtaaaggcggacgatcagttctccattaatctcctcattcgggtaggagatacctgcgtctattatccgttgactgaaacggtgtaccaaggcggaagtggaagcataatgttccagacagccgacggaaccacaggcacaaggttcgccattggcaatgagaggcacgtgccccagttctgtcccccggttggcataaccgttgaacaatttgccatcgatgactactgcaccgccaatgcctgttcctactgttaggaaaacaacatgagtggctccctgtccggctccatacattgtttctcctaatcccatcagattggcatcatttcctaataaagccgggaatccggtttccttttcaatgcggtccgccagatgtatgttttcccaaccgttgatgttttccgcacctcccagaactatgcggtttgtagaatctacgatgcccggtgtaccgattcctataccattgattttgtagccttgttcctgtgcaaaggctttcacttcattgatagcagtaaccaactgtccgatgacagcttctgctgatacatcggctttcgacggtaacttcccttgaaagtaaaatacgccttcattatcaattagggcgtattttacagaagttccgccaaggtcaattcctatagcgtattctttttccatatcaccaagtaatacttaatacttaaaaaaatcacactctttctgcccaaatcggtgaactccaagcccattgtccgtcacgttggcgaacgcgtacatagtagtagtccgtatcacgttgcggctctttatcttccatgtagtgttccaaagtgaaacagctttccggcatagcacgattgaaaaggatcgcctcgctcaaccaaccgatcatgaagtgtgaacgtgaacctttgagcaactcgcccaacgtatgttcaaacttcttgccattgaattcggcaatgatcttaccgtctttgggcatttccacatccagaatgacggcttgcatggctgctgtagtcgtattcggatttttgctgctatacatatccagttcggtttccttgttgccaacggatacgatacggttgacatgcgtgtggaattcagtttcaccttcttgcggagaagtgaacgctgcgccacggaaacaaggagttacactatggatctgtcctttgtccacggacagtttaccctgccaatgtacgtatttctcttcacgattccaaccaaaatcaactttaactttgcaacgtaccgtatcaccttccggggcaatcggagtcagcgggccattcatgcgagctaaaatctgtccgttcttgacaatatctacatagtcgatacagctttcacctgtaacgttcagatagatacggcggctgttaccgcgaaccacgtcacccatgaaagtgtcgttgaggcggaagtcgataataattttatcaccggttgcggcacatacatggcgggtgcggagagcttcccaaatagcgtcgcgagtcaatgacggagccatgacaccgatacgaccgtcgccatagcttcccggataaccggaatgttgatcggtagaagccatgataccgaatttgttgcctaattcaagaccatattgaatggttccttcccattggcgcggacccatatcgtgtagataaggataatctccctgatcgctttctgccagaccatgacgggaatacatttctacgaatggggtaatatctccttcggtaaagcatttccagttgtaaccgcgatagccgccctggtaacccatgtgatgtggagtaataaatactttgtgtccttttgccttctgtttccagtcttcgatagaagtacattccacaagcggtgcgtcgagatcataattcaatgcaacatggtcaccatgttccatgctgtgggcctcgtatccgacaaaagtaaggaattcaccttctttattatattcattcgtcatttttacgtacttctcataaccgccttcacgcaaacgtttgaaagctcctgtgtgataatcaatcacccatttcaggcggggatcatctgctccgggaatatccggccacatagcatgaggagtgacactgacaaaatccaattgtcctttcgctgcttcaaaagcgtcgcgcatgtcgccgtgtccgtatgtgatgttgcaatggttatgtaagtcgccccagtacattttgaggttactggctgacggcataatcttttttgcttctttgcttccagctgcgcaagaacccagcaaactgcctgaagctgccaatccgaggaaagaccagcctgtgttttttaaaaactttcttctatccatggttttatctaatttattcggtaaactaataatgaagcatattaattcttatttatatgtcctcctcttagcggttttgcatttgtcggcgatcacctttaaagaggactttttccttttcatccgggtcagtatctttgtactgtttttgagtgtcctgaagtagctccatcagctctttttgtactttagcatactccggtttgccgaagacgttgttcatctctctcggatcagctttcatgtcatacatttcccattcgtcaatatcgttgtagaaatgaatcagtttgaaatcttgtgtacggataccatagtgacgttttacagagtgttctgcagggtactcgtaataatggtaataagcagctttacgccagtcggccggggttttgccttcgttgaccaatatcggtttcaaagaagctccttgaatatctgacgggatatctactccggcaaagtcgaggaaggtaggagcaaagtctacattcatgctgattgcattactggtacttcctgctttgattgctttcgggtaacggatgataagaggcatgcgctgacattcttcatacatgaagcgtttgtcaaaccagccatgttctccaaggaagaaaccctggtcggaggtgtagacaatgattgtattgtccagttcaccaatcttttcgagataattcagtagtcggccgatattttcgtctactgccagaaccgtagccagataatcgcgcatatattgttgatatttccagctgattaaagatttgcctttcaagtcacctttgcggtattcggcaatgcgcccggcgtatacagaatcccatttatcctgaacttcaataggcatacgtttatatacactataaagacggttggttgtatctttcagcatctcttcacgagtcatcaatttgagatcccagtcgtttgtcaacgtgtgctcgatagacatatcctgctcgcgagcagctcttccacgaccttcgtagtcgtcgaacagattagccggttccgggaaagttgtattattgaatatgcctaaatgacggggagcgggcatccagttacggtgtggggctttctggtgatacatcatgcagaacggtttgttcttgtcccgtccttcaaggaatttaattgctttgtcggtaataatatccgtagcatatcctttttctacgatatgttttccgtcttcccagaaatcaggatcgtaatagtcaccttgctcatgttggccgctaaggatactccaatggtcgaaaccttgcggttcgctgatgaggtgccatttgccgatcatggcagtctggtatccggcttgctgaagaagtttggggaatgtctgttgatcgccgttgaatgtacttgcattatcggtaaaaccattctcgtgactgaacttgccggtgaggatgcaagcacgtgaaggtcccgaaagagcattgacagcgtaacaattatcaaagcgaataccttcattggcaatccgatccatattaggagtttggatcagattgcctccataacaggacattgcttgagtggtgtgatcatccgtcatcatgaagatgatgttcggctgtctgacttcttctttcttttggctgttgcaagaaacgaggcttagtgctgccaatgggaagagtagggtagaggaggtgtaatagttttccataatgataagaagcctctcccaagaaaaggggcagggagaggctttgaggctttttatagtttgtattttaatgactgtttctttccgtttactttcacttctacttccagaccgttttcatcgaacgctttgttcttgaatttagcgtcaaatttaggggcatctgcgcttttcttaaccgggtagataacagtgatgtaacgtacagcttcttcgccgtcttttctcacgttgaacgatacattcatacgtttgtagcgtttgcgataagcagttgaacaccatcctggttctttcttcatactcatgccagcagggccgaagcattgcagtttcatgttgcttccatcctcaaactgtgtcaggaacgtcatgtcttcgcggctgttggcaatttctcctttcggcatctgatagtggagattgatagaacctttaccgctacctgccatttcatctacaatgacaaagtaagtgttatcaacgaagaaaacagaacgacggtgtttcagattcttgtaactcggattttcagtcactaaagtctggatagcaccttccggttgccacaacttagtaacagattctgttgtatcgagattcttgttgtccagggttactgtgttgtgaacacaagtctgacggtgccagttgcgttgttccattacttcgccttcaccggcgtatacatacgaaccagaatccgggaacaaattcttgccgttgaaccaaagttcaaatgtaccattatccggctgacagtgccagaaagctttcggacctgcctttactaccatttgggtagcatccattccccatgaattacggaatacaaagaagcctgatttcaggaaacctttagacatataatccggcaatgcaccttcttttccttctgtagcaaagtatttgattgcctggttcttcgggaacagtttactccatgacttgtagtttttcaccatttctttctttgttgtcaacttggcgtcgctgaaacatggattggtgtaatcagggaaagaaatgtttgcatagaacataatcatgttttcaatggtatccaaataatcttgagggaattccttacggaatccgttagtatctgcgatacctaaggctttacagaaaatgttaatagctgccagatgataatgtgggtcaagttcgaactgtccgccatcttcgtatacctgtacgtgaatttcacggttcagaatgtcgataccactttttctccaagccggagcatctttgaattcagggaaaaaggcacctgcataaatcatgcgttgagcttcaaacagtaagtggttgccttgatccgagtaattagcaaggatatgtacagcatgtttgtaatagttcactaggaattctgtcaggaagtccggagtgaaagaaggggagggaaggaataactggaactgtgaagtctggtcttgcagacgattactcacttccagaggacgccatgcaaaacgtacgttttctacttcacctttgatttttccatcacttaccagctcatattctttcttgtccatcttcaccaatggattctttttaatccagtcgatatactggtgtgcccattctttagcatatttttcatcaccggatatacggtaagctttacccattggagtgaaccatttgtgacggtgcaactgccagcggagctcattatctttcaccggccagtattgccagttgatatcttctccataattgtaagaaggttgataacctttatgtacgaagaatgtatgtttcaatccgtcatccgcccattgctgttcttctttgctgatagtcaccttgttcagattgatatccggagtttttacgttggtacgtgcacggtaatagtccagcaatgctttggcagcatcctcatctttaccctcctgatgcaaagcttttactttctccagtcccggatagtctaggttaagaagagaaaagacttcgcttttcagttcttgggcataacccttgcttacgaaacatgcgattgcaagcagaacgatgtactttaaagttttattcatgatataataggtgttataattttatgtattagatatctttgtagttgatacctttcagatccatgaatctcttcaatgcttccagataatagtagtcagcatagttcagtggagtgtcgatttcagaaccattgggcagtgaacctacggaatgcatcaaaatgaatccttgattgtcacccacttttgcaagatatgcatcacttgacagactcttcagaattttttccgcataatccagatatttctgtccatcgggaaccattgtgcttagttcgatcattgcagaagcagtgacagaagcagcagatacatcgcgtggagtttctttggttacaggagcatcataatcccaataaggaatagcgtcgtctgtttttacgcgatccataatcatatcagctatatcctttgcaaagttcaggaagatactatcatttgtttcgcggaaacaagcggtatatccgtacacagcccatgcctgtccgcgtgcccatgaagaatcatcgttcttgccttggtgggtttgttttcgttctactgtaccatcgctgttatagcttactacatgccagcaagtataatccgggcggaagtgattatgcatcgttgtcatggcatgtttgatagcgatgtctttatatctattgtcgcctgttgcttttgctacattgaacagaagatcaaggttcatcatattgtcgatgataaccgggaagttccatgttccgaaatcccatgaacggatagcaccgatagaatcattgaaacgaccgcaaaggttatcggcagtttctctcatcacagcagcgatggtatcgttaggtgaaagacgttctgcattgccgtagctacagttgaccataaatcccaaatcatgtgtacctttataatagcgtaccggattcagaagattggtatattcgattgcttgagttttcagtgtatcgtttcctgtcagttcgtatgcataccataatgaaccggggaagaaaccgctcgtccagtcataaacgttgcagaggcgacgtttgcctaattgctcggcagtaggttgtgcacgtagggaatctttaaatgttaatgaatctctttccaactgacggcaaaggaaatccatgtcatagccggtacggatggagcgtggcaacatccctgtaccactaacctcttcagcagaaagttgtaattgggcagaagctacatccagtcctttttttatccaactgtagtcttcctttggggttgtctggcacgacgcgagtgcaatactaaccgaagcaaagagaacaagtttctttttcatgttattcattttaagtgattgtttttagaagttttgtaactgatgcaaaagtaggcgaaagacctaattttgtgttacaggattgtcgaaaaggcgtttaaatagagcttttcaagttttgattttgttgaaaaaggttttaaatatctccaatatgccctatttaaggcatattggagagaagttatagagattttgttaccaaccagggttttgtttgaactgaatacacaagtccttttcacgttgtggaataggcagtaattcatgtttgtttttctctgtatatttatataacaaatatctgtaattatctgcagaatcccaccagtttgctaaagcagcattcgttttttgtatagtttcataatagatgccccagcgaactaaatccatacgacgatgaccttcaaatgctaattcatacgcacgttcttttctgactgcttcacggaaagtttcttcatttaagtttgaaaggtcgcagcttcctgtattgctaggatatccatatccacgacgacgaacttcgttaattgcagcataagcttctgtggtaggaccatgtttccattcattcagcgcttcggcatagatgagtaatacatctgcataacgtaagaaataccagtttgcgttagatttatcgttattgataaccccacctgtcttttggtattttataagatcccatttggctggtgtatagttttgtttttctttttgagcttgagtgggatcttggtcttttaattttgcagattcttccgtgtcacttttacctttagcccataatacgtaatcgtcatcatacttatagtttgctactgatagatcgcgacgtttgtcatttgcatttttgccgtctctccaatcgagcacgaatgtatggactactttcatatttcctgcacaactacctcgtacaccggcgatagctgttgtttttactccattccatttgccgatacgccctacaggatctccagaaccagatacggtaggagaatagaatgaaatctcgattaagctttctgttggatcccatacactgctacaagtattttcccataacttttcataattgcgcagtaatgaatgtttgccggattcgatgaggatacgtgctgttttggcagcatcttcccattttgctgtattttgtacaggatatcctgcccatgtagcatacacttttgccaagagcccaagtgctgcccctttactaaaacgatatgatgtgttctcacgaagctgatcgtcgattgcatatggtaggacttcactagcataaagaagatcgtcttcaataaattcatatactttatcaggagtagcctgtgtaaaagtagtaggagcttgataagacatctctgtactggtaatcaaaggaatatttccataacgacgaactaactcgaaatagaacatggctcttaacgctctggcttcggctatataaagagttgcgatttttttatcagtagtattataagtctctatttttccactaatacgttccaggaagtcgtttgctctgtagatacctttataaagaacttgccatgtttgttgaatttctacttgggtagtaggaaaagcgttattgacaatgatacgataattcgttatatcggaaccttctccttgagatatatctgttcccatgttgaacaagaaagatagatgatacccgtatgcagcatcttcaacagttgtacgatatactcctaatagaacatcttgtgcttctttagcattagtcatgtaattcttcttttccatttcgcttcttgcctcttcatctaatgagcatgaataaggtaaaatgcacagaatggacattgctatgtaatatattaatttcttcatattattttctcatattagaactgtaaatcaataccaaatgtaaatactctactcttaggataagcaccccaatccagtccgggagtcataggacttttgctggctgtacttacttccggatcatatccgctatagttgttaaggcagaagagattttgtccggtagcatatacgcgaagtttggatacatggaaactacgagtccatttatgaggcagtgtatatcctagtgttatattctttaaacgtaggaaagaaccatcttctacaaatcgtgaatacacatcgtttactacgtatccattgtagcgaggtaccttgtttgaagcgtttgtcggactccaacggtctgctacttctgctaattggtttctacgttgtgtattggtttgagttgcatacaaacgggttgcattataaatgtcattgccgtaattgaattgcaacataaagctaaaatcaatacctttatagttgaatgtgttagtgataccaccataccatttaggcaaagcattaccgataacagtacggtctttagttgttattactccatcaccatcttgatctttatatttaactgctcccggagacaatctgtttccaagacttggattgcttgttacgccttcctttaatattaaagtgctggaacccggaactgaataaaaatctgaatattgataaataccatcaaattcatatccgtaaatcagaccaagcgattgtccgacaatagccatataatcatatgaagtgaaattgctatcaaagccagaacgtgcttgcatgtagtttactcctgacgccagtgacttcaatgtattcctgatgaatgatatattaaagttggtttgccaagtaaaattccgagtttgaatattggtgctgtttaaacttaattcaatacccttattttgaatttttcctacgttttgcatttgtgagtcaaatcctgtaatatgtgccagtgattgtgacaatagcaagtcttttgtattcttgataaagaattcagcggttaaatttaggcggttgtcaaagaaacctaagtcaatacctaagttagtagtgtttgatccttcccatttcaaattcttatttctaagttgtttaggatttaaaacagtaacactactattgcctatgccatatttatttgcttcatataggtccagagatagatagttaggtatattgtcatttcctactgtaccccaacctaaacgaattttgaaatttgaaatccatttaatatctttcatgaatgcttcttctgatacacgccacgctgcagagaaagaagggaagaatccccatttcttatttgatgagaataccgtagaaccatcggcacgtactgttgctgtaaatagataacgattgtcgtaattatagttagcacgtgcataaaatgataataacgttttatcatagtaagtactttcaaccttacttggagttgcacctagccccatgttgtcattttccatttgatcgaaagggaatcccattgcttcacctaacaaatattctgtacttttgtaggatacttcgtgtcctagcatgacatcataattatgtttctttaccttttgtttccaggttaaagtattaaagttggtccagcgtacatcgcgttgcatggttgtacgtccataaggttgttcaccattacgatatgcttccttagagccatttttataaaaaatgtcagtgcggctattggttgtattatatgtcccggcactcttaaaagtaagtccttgtatgatctgccagcttacagatgcatttccagaccacatttcgccacgtttattgttagttacagattgagtttgcataacaggattaacctgtgctaggctttcgcctgtttctagcatttccgggtcaatggccgaatgcaataattcttcgtcggttagcttatttccacctgtgggacgtgcgctaagtatctgagctaacatattgaagcgtccggaatcagctgttgttcctacacctttacgattagttaaagcatagttaatagttgcattgaacgatatatttttattaatcttttgatctatacgaaacttagctgttgttttgtcaaaaccgctgttgttgaagataccgttttctacatagcgagaaaaagccgcattatattgtgtatcattgctaccacctctaagagagaaattatgatcttgagaccaagtcgggttgaaagtctcttcttgccaatctactccttttacgcctacataatcttctaatgaatggtatctaattggttttccggcatcatcaaattctttgtcagaaatgtaactgctcaagagatcattattaacttcaccctgtaatttcacaaattcgtagggagataatacatccaatgttttagagattttacgataacttgcagaaccattatagctaatttgtggtttcccgctttttcctgattttgttgtaatcatcacaacaccatttgctgcacgtgcaccataaatggcagaagatgaagcgtctttaagtacttcaatagattcaatatctgaatttgataaataatcaatgtcgtctacctgaaaaccgtctacaatgtagagcgggcttgaatcacctgtcagacttcctacaccacgaatgttgatgttgaaccctgcaccaggagtaccatctgtagatgtgatttgcactccggctatttgtccacctaatgcacctgctacagaacttgtttgaaatccttcaatatctttggcagcaacagaagcaacagaacctgtcaaatcgctacgtttcatcgcgccatatccaactactactacctcatctagtgcctggttatctggaaccatttttatattaatggatctttgaccattgaattttagttcttgtgttttataaccaatgtaagagatagaaattgtagctcctttttttgcttttagagtaaattttccatcaaaatctgtgatagctcctgtcgaggtgcctttagcttgtatagttgctccaataagaggtgtgtctgtttcgtctacaataacaccttttaaagttaattcttgagcatatacgctgattgtgactatcagtgctaagagggtgaaataccctcttatgcttattgatttaattagattgtttatgttatacataatttctatttttaacgtattagtatttagaagttaggatcgaaccagatgattagcgggaacacctgactacctttttgaggatctgctccagttttatcgaaagtcatctgacctgtgaatataccattaggatactctccgtctaaaacccatttattaggattcaatttgagggcaagcccgttagtaggatcaacatatcctatagcataacttaaagtgtttttatttttctctatattggcataataggaaatagcattcctggaacctgtgttaacccctctaccagagtcttctccgaatttagtccagagagtgttcaggaagttagaagttttaggatcgccattggtaaatgtaccgctaattgccgtatagttaaatgaacgtctgtagtctaaagtgaacaatgataaagcttccgcatctatacctttaataattggtttttcagaataagtactattaccaattgtttttggattaacttggaatacaaatggattatataatacatgaacaccagctataaccaagtcataatgtataaagacaggtacttccagtgagaattcagaatctttgtcttcaccaacagtggctgtaacaaagaagaatcctgaaccatttgtggctactggatctgttgcatctaatcctggccatatagcatttgcaaatgaaatcttaccattttcatctatttccaacttatcacagttctttccgtttctgatactccatcgtacattttttcctgtgatatctgtagtaggagcttctattgtgaatttacttagaatcgtagcagcatcggctgctttatctactgtgattctaaattgattggcattgcttattgcatctaccccaatgttatttccgtagcgtatgaagctaaatttattcggattattcttaacctttaagttgaatgacgcttcttttgaatttttagtattagatgcagtcactgtaatggtatagtctccgtttggtatggtgtggcctttctttgcagatactactccatttttgtcaatagacaactgtttatttagatcatcctttaatgtgaacgtaatcccatctccttcaagtccttcatcaggagttacttttaatggtgatgattcatatatttctacattcacaggatagctaaagtttgctacaggtacaattctgtttactactttaagagtatatacattgttaaatgatactccatctgtagcatatttatttgctacttttacagatattacatattcctgacctatttcaaagccgtgatgtttgtcgacagagagtacacctgttgtcggatcaattttaattttatccgttgatggttcgatgcttttaatagaataggctatattttccaaagagccttttagcattggagcttcacttttgaaagtggtttcgggtccttccgctgtttcagcttctatcaatccttcgttaggttcataagttaatcctaaaggtttagatgtgacattgatagtcaatgcattctcaaagattccttcatcttcagacgatgcgccggtagtgagttttaatgaaagagtatgtattccaggtgcaatatcgcttcctcttacaattgtaatttctcctgtttgggagatattgaagaatgaagaaatgtcactttttgctatttcatatttggtaatagatacatgattaccatcagtcttaacttgtgctgtaggtaattcttccgtgctttctgcatctgaaacaatgctgtattctatttgaatttcattaggttctacagtgatgccatccggtacaggtttcatcatgtttacttctacaatatccttgtactcatgatacgaaccaccagccatacatgaaatggaaattttatataagcctaccggtgtgtcttttgcactattgatttcaatagcaccggtttctttattgataataaaatcactacccatataaggttcaccgtttaatgtgatgcttgtgattgtaaaatcggaaggaacgctccctttgtaagaaggctctgaaatgatcccgctcatagatggacctatatcggtcatgcctaaataataaagtgcgaaaccagtagtgtcagtggtatcctcatctgaacaagatgtataggtcatgactaatacaactgccatcaagacacctaaaaaatgagaaatgtcttttagtaatttagatttcatattatatgattattagatttattttgaagaaagatcgtacactgtacctttgactgtgacttgaatagataccccttctgaatggaacgttccagccgttccatcttcattatcagtaaatttggcatcaactttcagctcctcccgttctgtatcgttttcaaatgggcagagaattgttatatagcgggttgcgctgatttcaataggcgtaattttaggctgacgaagagtgatttggtagcctagacgtataggaccatcttctttgtctgtgtttgtagatactacattggtcacatctgttgtagataatgctttggctgttagatcttgactcgtttctgtaaatgtgccagcaaaaatattattactagcaaaattagtgtatgcctgataatacttattattgtttacagatgtttgcagatttttgtcaaatacagaaggagtatctttatcactaagcagatggaaatttatatttgtcttagtaccaagcgtagatgcgccataaccttcgtctacaatcacaaagaatttctgattaacaaagaatacagttctacggtgggtgatgtcatctgattgttggttttccgtaactaaaatgtctacattatttttagtttctaatttgatcatttttccttccattacgccaccttggccggttggcttagcaactccaatggttttactcataatagtcattgtattatgattaacagttgaagcgtatttagtacgagcagctccagtattgtaggtaaatacacctgcatcagggaagaagttacgatctttgcggtataaaccgaaggttccattgtcaggttggcagtgccattgattggtaggattgtagttgttctttagaatcatcatggttgcatctttatcccaaccgctgcgtaacatataataaccagaggtgctataagctttagttgtgtatgaaggtttacttccgttctttccttctgttgctacccataatagctcattattgtcaggatacatagcagaatattcctttagcctattcaacaaagtgcttttagaatatgaagctgaacgggtatcattgaaattgtctatagtataattagggtaaatcatatccataacaaattctgttgctttctttagtttgctgatgtagctgggagacaataaattagttttgttgttagcttgagctataagatatatttctcggaagtcactaatggcagcagtatgatagctaaaatctaactcatattccactccatcatcattaaattgtgtgtctaatgattcgtttaatccttgtgttccttctgtagcccatgttgatgcattcttaaattccggcattagcatgccagcagtggctacggcttgatattgagaaattaagatattgccactttgataataattcaatcgaatacactctacctctttttcaaatgcaaccaagaaagtagaaagccattccggagtgaaatttgtggaatgaataaaatagggcataatgtctacttgggaaagaactctttctgctacttgtaggcctttccattgatagtctacatcattttcggaaccgccagctggtgggaatatggttccgggagtatatgggaatgtttcgatccaactgccatatgcttcaatccatgattggatatatttttcatctttactaatacggtatgcttttgcttggggaagcatccattgatggcgatgaagttggtatctgaattcttgctcttttttctgtttatcttcgttggcattccaatctattttctttgcagatgcatcatagaaagaataatatgtttctagtttagttacttcatctacactttcggcgaatccttttacatagaaacgatgttcaagtgcttgatcggcaatgcgttgatctttctcggaaattgttgggttaatcaagttgacattagggttgtttacgtctactcttgttctataatactctagtaattcgttagctgcataatagtattctccattttcatagaattttttcactttctctaatcctgggtaatcgaggttaatgatctcaaataactttgagtctacaacttcattaggtttgttttcaggaagtatttctactcctggactaacttcacctgttaataagtcatcatcatcatctacgcatccggtaaaagcaacggttgcgaacatacaaataaagaagatgttcttcatactttattaggttttaattattaaaagttatattttactgtttgcaaaattagcttattaaattatagactacagtctggcttgttcacactttgttcaaaaatgatttttttgatattaaatttgttgaatcatatattacttctgtctaaaaagcctgttacggatctgatagcaggctttttatgtatcataatgtaatctaatctaccagtgtttacaaggttggttttgtacatttttacctcctctggtgaatgatttttaatccataatgatttttagaagtatgaggaatcggagaaatgataaaatctggcttttctccttggggggaaatgaagacctcttctcctttctttaaatcaatttggaaggtgttgtttgggaatgattgtatagtgaagtttctttttccttcaaaaatagggttaactatatcagtcgttacaatgcaaggctctcctgccagacttttaatatggataaattgtgtctttccttgctttctactggcagatactttaaatgccccttccgtgcgcagacctgaataagcaatgtctttccatgtagcggggatagctgggaaaatgcgaatctttcccccccaactctgtaataacatatcgtgaatgctttgggcggcagataaaggtgtctcaataactggcccactttctttatacatagtcgtcgaactaagaaatttaccaaataatttatttagataggctagtgcatcgtctccctttccgatagcagaggaaatggaagatgctcctgtgcatgagtaacctaggagagctgtgggcttgctttgccaaaaagacaatgatttctcaatcatttcaatatcattcggttgttctttattaattaagtatagaggataaatagcaagtaaatgtgaataatgtctgtgtgagaaagcatacggcatatcttttccgataagtaatccattctcgtctgtggggtaaggagtcagtttaagaagcacatttttccatgtctcaatcaatgaatcttggatattcagacgatgggctgattctagtagtgtttggcatccccaacgtagcagagcgaggtcgaaattgcaatcttccacggtgtcatattcgggggagtaagttgctgggagatgaagttttccatcgtctccttctttcaggaaatgcaaatagtagttgattgattcttttaataaaggaaataatttatttcgtaaaatatcatcatccattttatgtcggtagataagccataggttgtgacaggcccatggaagtagtcctacttgagctttgccttttcctggaattcctacttctgtagtcatacattccaaattggaagcaacccctattcctaatgagttatggcggtaagctttgggaatgttgaggcgtaactgatctatatgattgtagagggcattttctaaagaagctgccagatctagatggtcggaagtattcagtgcccaataggtaagttgaacattgagattccaccagacattcggccatggggtttcggttagccacgggcctgtgttatctattagagcacgatcaccacgtgttgcagaggctaatttatacatctgtatccagtagaagttttctttttgtgcttccggcagtgttatgaaactactaggatagaaagtattccaccatttacgatgtgttttttgcatggggtgataacctttacgtatagcttttcggatttcagctttgcatatttcactcgaattgttttgaggatatgtatgtgttaggtttatccataaggtgcgttctgtttcggggttatgtgtttcttgccatccaatgctcgtttctcctcctgccaataatttctggacagatagattgacttctttctcattactgatttttgctgtcggattaagttcgtaatcttttggtattttattggcttttccttgtcttttgaaaatcaaataacgaggactattagcttcagctgctatccattcccattggaagtcatgttcgtctccttctgttgttgcttttactattatcatcatttcatccgcatggacaaaacttcgcaagtggatgactcctttagttgtcgtaatatctgttgaaacttcagcattccaaaggtcaagatgcatcgttccattgattattttgcccttaggatgtagggcaaaatgtccggtaagtagtctagggattccgaatacatctcttttagtgcggtgatcatgtacatcgcagttgcctgtttctaagcgcaagtagttctttccaggttctttataaatcattagcccaagctttccgttacctaaaaaggcggaatcataccaatattcgggtaacttttcccatatcatatcttgttgactcataaattggggccagtcaatatcttgttttatagttgccgggtgagcattcacaaaaagaatactgattaatgataaaagtaggtaagaatacagtttgtttaaataattcatagtatgctttttcatctattaattaataatgctctctctgcaaatatatagagtatgacaattttacgactattggtattgttgaatagtctttcatttttgtctaatgtttttgtttgtatggggtaaagaatgtatttcttctttaaaggttgaagattttcgggaattagctttcagtattcgttatgtagaatattactccttttagatacaataatgatcttattggctacttttaagtaatagcttccctattgatatttatttcattgcctaatgagttttcgtttgacttaagtcgaacgatagtttaactaaagtcaagctttcgttcaacaactgtcaaacgaaagctcgcttggtaataagataaataatgctaataagagaataaattgaaagctgcatagtaatgtattattatcagtaatagcattttatgttcttttccgaaccgaaatgaacataaatctcaagccagcagattcatattcggaattcactgatttatccttttattttcttaatatactccgtgggtaaacatccgaaatacttcttgaaactcgtagcaaaataagacggtgtattgaatcctaccattgtactgacttctgctattgtatagcggccatccttgagtaactttgctgcttcgttgaaacggatctttcgtataaaatcgatagtcgattcgcctgtgatagctttcaatttaagatgcaggttagaacgactcatattcatttctctggcaaattcgtcagtagagaattcaatattatccatgtttttttctacaatagctacggcacgtttcagtaaagcttcatccatggcgttaaacgtaatcttttccggttccacttccagggatttggaataccgttcaagcatacgtctacgggtacgcatcatattctgtatcttcgtagtcaggatagcaagtgagaatggtttcgggatgtaatcatccgcacccatttgcagaccttccatctggtctttgacttcgcttttagcagacaggataatcacgggaatatgacaggtacggatattttgcttcacattcttacacagtttgataccatccatcacaggcatcatgacatcagttacaatgatgtcaacttcattgtctttcagtttttccaaggcttcttcaccattcccggcttccagcgtattgaagagttctgcaagtccgctgctaagataatggcggatttcattattgtcttctacaataagaatagtgccacgcttcttgtcaccggcttcgatcgtttcgttttcgaccttttccgtatcaatgaaatacatttctttcgagttggtggaatatacctgaccttcctcattcagagtgtcattagaagccaactcggaggatttataggtatttatgtcttgtggcagatagacagagaaagtactgcctttaccctcttcactatccagttcgatacgaccatggtgcaattctaccagacgttgtaccagtgaaagaccgataccacttcctacatgctcactctctatctgataaaaacgttcgaatatttttccctgtttgttgataggaatgccaataccggtatcactaacttgcagtaccagccaattattttcctcttttaatgtcacagtgatactttgaccactttccgtatatttgaaagcatttgaaagcaggttattaacaatcagttccagataattaggatcaaaaagttcctctttatcttccaattcggaatggagagtataagtaatctttttgtggtgcgccagtttatcatagaacaagaaattatcttgtatgagttgatgtgcattctctttctttacttttaactcgaaaactcccaattcggcgcggcgataatccatcaattgattgacaagatgtagtaggcgattagcgttgcgttggatatattccagttgattacgagtccagcggtcactgatcttattgattatttcttgtagaggagctaagataagagtcaacggcgtgcgaagctcatgggaaatattgatgaagaaacgcatcttcatctggttgatttcttcttgatgttccttatccctgcgttcaatctccaactctgcctccatgcttttacgcatccagaagaagcggaagacgaaagtgataaagccgataaaaatagcgaggaaaagcacgattgcccaccaggtcttgtaccatatagggagaacaatgatttctaacatcgtaggtacagtgttccatttcccgtcactattagcagcttttaccagaaaatgataagtgccttgcggcaagttggaataggagacagcacgtttgtctgtcagataataccactctttatcatatccttccaatttataagcgaaagtattgtgttgacctgaaatatagttggataccacaaattcaagtgtaaaagccgtttgccatgattttagcgtgatactttctgtttcattgatattcttagtcaagataccggtttcatcatccggacggactgttttgttaaacagttgaagtttagtgataactaccggaggagtgtaagggttgtccagtaggagttccgggcggaaagttgtgataccgttgatacctccgaagtacatttgtccgttagaggtgcggcagaatgaagaagtattaaactgattactttgcaacccgtcggattccgtaaaattgcggaacttctctgtctccggattgaaacaggagataccacggttggtgcttacccagagacgcccgaaagtatcttccaggataccgtagaccacattattgggtaaaccgttagctgttgtatatcgtttgattttcttctctttttcattaaaacagtagaaaccttcacgcgtacctacccaaatgatgccattggcagcttcataaatgcaattggtaaacatctttgttacagatgattccggaaggataggagctttttctatttcgatcccttcctgctgaaagactgatataccttcttcaccaccgatccaaagacgtttacgagaatctctgaacaggattgtgattcgttgtgaagtaaatggcgtaccgtctttttctttatctatggtggtgaagctccgtttctccggattaaaactaaccagtgcacttaaagttcctaataagatactaccttctttgtcaggaagaatggcatacacattttcattgaccaactggctattcagctgattgaaactttccatttgtccactgttgcggtggagaacagtcagaccaccggcatgtgttcctatatatacaagtgatttttgttcgtctacatatacggctttgatattgttggaaccaataccgatttcccgttcgtcttcctgcaggatatagtgtgtaaactgttgtgtctttggattatatagattcaatccaccatcatttgttcctatccataagttcttattcttatcttcggtaatgcaactgactacattgtcacttagagaattcttatatggaatacgttggatattcttgaatctgttgcggatcggatgataatagtttagtcctccgaaataggttccaagccacattccgccctgcgaatccataaagatactgcggaccgaacgctgtgacagactgccgctttctaccggactactgctgtaagaaacgaaagaatcgtttccttcatgataaatgtttagatcattgaatgttcctatccataggcgattttgcgaatccaatgccagagaacggatataattggaactgatacttttaggattggaagaagaatgatgataagctttgacttcttgtgttttcgggttaaatagaagtagaccggctccttcggtagctatccagatgcgggtaggagattgttgcaaaatggcttgaatctgtttagtgcccgttatcggagtaattctttccagtttcttttgaggaatggagtagctgtaaagcccgtcaaccggggtgccgatatagataatatcgccttgcctgtaaagagcagaagccactatcttatgcatagccgtactaaaagaatcatcaacgaatcgtgattctttaatatcgaacatagtcagaccttcctgtgtacttatgagcagttgttccggtgagatctccgcaataccgttgatttgcagcttcttccccttcttttcgtagaagaaatttctgaacttatccttctcctcatcataatatgacaaaccatcccgcgtgccgatccaaacccgtccctgactgtcagtctttacgattcgcgaaatgtcattagcgatgctgttcggatcatcttcattgtgctgataaactgtaaatgaatacccatcgtacttgttaactccgtcataagttgcgaaccacatattgcctcgttggtcctgatcgatagagaatacagtactttgtgacaatccttcattaatagagatataggagaagttgatttgctccggaatatcagaaaaagcataattaacccctgcgcatagaaaaagtagacagattgctattttgttaaggctgctcattattagttcataagattaataatggcatcaaagatagtgaaatctttgatataccccatgaattggctggaaaactatacaatctttccgccccgcgtcaaatgtcttttttcataatgaggtgattctcattgtcgatacgttggtaagatatttcgttcataatgcttcgtatgaggaatattcccagacctccgattggacgttcctccaaagaaagtgtaacatctacttcatctacttgtgtcggatcaaaagaggctcccttgtccgttaataggaaaacaagttgtttttcgctgtaagttactcttaataggatggtgtgttgctcttgagttggataggcgtacataataatattggctacggcctcttccaatgccagattgatattcattgtcgtttcaaatgacaaagaaagttcctctcccagttcttcgatgaaactggctaaaactgaaatttcatttaaatcgtttgagatctttatttctctttccataatgatatgtgcttaattgtttgttgtcccgggttcatattgaataagtaaaatagtcaagtcatcgctggcttcggcttccttgacatgctctgctatagagtccactataccattaacagtggtgcgtacatcagacgtgttattatcagacaatgtcttcaataacttttcgtctccatatagctctttctctgtattttcagcttctgtcactccatcggtgtaaaggaacagtttacttcctttttccaatgtcgtttcatcttcggtataggcaaattcttcaatgacaccaacaaatatctgggtcttgaattcaaggaaagaaacctgtccgtccggacgaatcagtatgggaggattatgtccggcattacacagtttcagtttccccgtttccaaatcgaggattccgacaataagcgtgacaaacatgttggattcgttattatcagaaatcgaattgttcatgtccgtcacaatcttggccggtgaaagcacctgctgagataaagtacggaacagactgcgggtgattgccataaacagagaagcgggtacgccttttcctgatacatccccgattaggaagtagaggcggttgccatccatatagaagtcataaagatctccgcctacttctttcgcagggtgaagtatggcatgcaaatctacatcactacgttcggggtagggagggaatatcttgggaagcattcccatttgtatttccctagctatagaaagctcgctttcaatccgttctttgctggcagtcgtgtcttttagttcaactacgtaagtagataaagagtgctgcatgaagataagcgaatcgtatagatctctgatttcatcgttggaatgcacttctggtatggtaacatcaaatcgtccggtcgcaatttcgcgggctgactcggagaatttctccagtgggcggacaaggcgtcggatgatgctgtacacaatcaggaatagggctatcatccccactataaaagtgtagatgattgttcgggatgtactgtctagttcctgaagaataatctggcttggacaaacggtgcatactgaccatccaatctggggaatagttgtgtaaaatgcatacgaatctactcctttgttatcgaaacgcatggttccggtgtgtcctgccagcatttcatgtccgatctgttcctgtgcaagattctctttggcaaaggcttcagagaatatcgtttcgttcatgatcttatttctatccatgtgagtcaggaaacttccgttgcgactgattaaataggtgtagctggaaggatatggcttcagcaagctaattgtatcagtgaattgtgtcagtgatatattggctgtaaagactgcgactaattttccatcactgtcaaacagcggtttggcataagtactcatgatgaaatttccccctccgtcatcataataaggttcactccagtaaggttgcttaagtagttgggggatgagataccagtccatacatggatagtcataattctggctacctaatacctgataggttatttctccatttatttcatccttaaaagaagcatagggcatgaaatatttccctttttctttgtaatagttgggaacgaaagctatgccacttccaacgatgaactgattgtttcttacaacagattcaataatattgtgtaaagagtccgggtgattaatgtttctttccaagacccagacagattggtttacagtcgtcttaacagacagtagctgaccgctgatttcagttgcaatgttacttaatagtccatgagtacgttcaatggcaaagtccgttactttctggtggctataataataaaatagcgccataatagtagcaaagataatcaacgtaaaggaaagtacgtagatacttagccgggttgcaaaggaacgggaaaaagtgtgtttcatgaatgaatgtgattattttacgaaattttcataacgaatgtcgctggtgtttttgatttgatctggcaacaaaatactagctgccagatcaaatacttctcggcttagccgatagggacgttgcccgctcttcctgtttgtttgtagccgtaagatctcatccaacattttacgctggtgatatctgttggttcctatgttgtgttgatgcacttgttccattataatgtccaatgtttgttcgcggtgttcgtttgcccattcccagccacgtatactggcacgggccaatttctgtacagcttgaggatatttctgatagaattctctgctaacataaagtccgtcctctggcaagttatatccataatctgcgaaatgcatgatatgaatagaatcagtctttacaccggcttcaattagttgtagaaactcattgtaacttcctacgagacaaatatctacagctttcgataggaaaatgttgactcctccattgaaacgtatccattccacctggagttgatatttgttggctatttgatccagtagttcttgactaagatgattccatacccctattttcttatgttgcaaagatgaagtacccttgagtggcgaacgactgacaagcatcagactgttttcctgtgaggtttgcaagatattaactatctgtgcacctgcaaaatattcagtcaaggcatacgataggttcataactaccgcttgcgaataccctttctgcagaaaagaaaaagagcttgccgaaagcgaaggatgtaccacatgtacgtcaagtccctcttccttgtagaatcccagtttgtcggctacgtaatagcctgcaaattgtgcttgtgccgtccatttgggtgtgagattaatggattgtgcattcaccggttctgtcagaaagaacagagatagcaagatactgcaaataatagatgcttttctcattatcaatggaattaacgaatgataaaaaggccggaacagcctgtcatatcgaatattttccgtatttccgcacgcatagcttctaatacaagttgtccgttgtgttgctttacacttttctggagggttatcaggcttcttaaaccggaactgctgatatatagtaatccttcgcagttgattattatattaggattctgaacgtttaataaaggttggatgagagcattgaattcgttggtattggcagtgtccaatcgtccttcaacagtgagtatgattacttcctctattttacataaattcgttttaagagttgcttccggtttgaaatccatttctatatttttagtcaggattagttcgttttggttgtccgtcgaatgatattctactttatccattgttcggcgaatcaggaagagtcccaaaccttgtgtcagttgctgttccagggatagtgcattttctgatgcttcattttcagattttgtgggatcgaatgaaataccatcgtcaataatctgggcaatcagtaggccgggggccacagaagttctcaatgtaatttcacctttttgattttgaggataaccgtgatggataatattgcttattgcttcttcaatagctaggttgagactcattgttatgccggaaggtaaatgtaatgacatgcctaattcttcgatgaattgggcaattattgcaatttcctctacctgattttcgatagtgatttccttttccatattctttaagtagcgcgtcatattataatttattcttgtttggggtgaatgctgccacaaaagtattagtaaaggtgaaaagtctgaaatatattactcccaaatggttcccattttagcaaatctccctatattgggacgctttttacgagtgggatgctcccgttcttttcgcgaaaagactacttttgtcgctcaaaacaaaaaaaacatggtaaacgtaattgttctctgcattgaattgttgttggatattgtgggcttggtattgggaatacttgtttattcacgttcttcagataataatggactgacaaaagcatggggagtattggctatcactctgtcccttcttcttttgtgtgataatctggaatggatgtggattttcagtagaggaggtgaggagacgattccgcgttttactgaagttccgatgaatcatctttcgatatggcatattgtccgggtgattgtcttttttcagttcttttctatttttcctatagcctcattgaaaccgggatggatgactttttcaagagtcgtcagtttatgtatccctattttgctgattacatgtatagcttgttgctatgagttttttaacggtcactatactactctaaaatcttttgcttccattcgggagaatattggtgaacgggatgtacgggtaaggctgatgctgtttataatcagtgtaattactccttccgtaaatttcctctttccatatatgagacgatggattcccgtccggcgtaaacagagccaggcaatgtctatttatatgatgtgttttgctatcatcatgtccggctatatttggttgatgctgggcactagtggattatgttttaacgtgttcggctatattgtaatccttcccgtcctttttttaaatatactatatttgcgtaatgagaatccactttctttacctccccagcctgtagaagagctggagatggaagaaatagaagccatccgggaaattgcggtttcgcctgtcgtttttgaactatccaaccagatgcaaagtctcatgaaacatagtaaaccatttactaatcctcaatattccttgcaggaatttctgaatgatttgaatacgaatgaaaacagactcaataaggctcttcattatgatggcttttccggtttcagagattatattaatttctaccgtttgcagtattttaaagaacaggcacagttgaaaagggagcttacagtaaaggaattaatgtttttgagcggctttacctcccgctccagtttttaccgttattttgcgagtgtggaaaaaatgtctcccagtgaatatatggagatgctcaatagagaaaataaataaggggtgtgggaaaagaatcaccacagatcatagaattagcacggatttgattgtaattcaaagattatcaatgcagaatcgatgtttcttttatgtaatctgtggtgaaacttgaaactggcaggcaatttattatttagctaaatctcctatttcgtctaaattcttctgaatatcatcatcagtcaatgaatagtttaccaagtcaccggccaaatacttatcataagaagtcatatcgatcagtccatgtccggaaaggttgaacagaatcactttttcttctcctgtctctttgcatttgttagcttcgcggatagctgctgcaatagcgtggctggactctggagccggaataataccttcagactgtgcaaacagacaacctgcttcgaaagattccaattgctgtatatctactgcttccatcagattatccttgagcaactgtgaaacgatgacacctgcaccatgatagcgaagaccgccggcatggatatgggccggagcaaaattatgtcctaaggtaaacatcggtagcaatggagtatatccggcttcatcaccgaagtcatactggaatttaccacgtgtcagtttcggacaagatgcaggttcggcagcaacgaaacgagtcttttttccttcctgtatcgtgtgacgcatgaatgggaaagagatacctccgaagttggaaccacctccgaaacaaccgattacgatatccggatattcgcctgccatttccatctgtttttcggcttccagtccgataatagtctgatgaagagtaacatggctaagtacagaaccaagcgtatatttacagttgggagtcatttgtgccagttcaatagcttcagaaatggctgttcccaatgaaccctgataagtagggtgtttagtcagaatatccttaccggcacgggtagacatggatggagaaggggttacctgtgctccgaaagtctgcatgatgctgcggcggtatggcttttgttcataactgatttttacctgataaacagcagcttccaaaccgaaaaccttagctgcataagaaagagcggctccccattgtccggcaccggtttcagtggtgatgttggtaactccttcttctttgcaataataagcctgtgccaatgcagagttcaacttatgtgaaccgatagggctgacactttcattcttaaaatagatatgagccggagtaccgagtgctttttccaatccgtaagcacgaactagcggagtactgcgatagtacttatacatttcgcgcacttcttccggtatttcgatccatgcatcggtctgattcagttcctgatgacacagttccttagcgaaaatcggatacaagtcttccgctttcagtggttgtttggttcccggatgcaacggaggcataggtttgtttaccatatccgcctgaatgttgtaccagtagtgtggaatttcttcttcgggtaagatataccgttttcttttttcactcataatattgtagttttttagtttcttgttgccaaaagtactcaattttttaatattcagaaaattttgtcaacaaagaatcggttctaattgttattttacttaagtttgcacgaccctgttaaaaaagatgatatgaagatttatcataagtttttattgtatcagaataaactgctaaaaccctatgtacgtatcctgttaggactggtagaagcactcacttatctggcatctctgttgttgattgttggagtagtatatgaacacggtttttccttatccgtagatgaagtggctaatttgcagacattgtataaaactgtctggattatctttctgattgatgttactttacatatttcactggaataccggaatactaaaaaacaataccggcgattagcctggatattaagcgggttattatatcttactctagtacccgtcatttttcaccgtccggaagaagaaggagctattttgcagatttgggaattcctgcatgggaagttttatcatctcctgttattactagtcctttctttcctcaacttatccaatgggctggtgcgcctgttgggacggcgtaccaatccgtctttgatattggcagtcagttttatggctattatcctgattggagcaggtctactgatgcttccgcgctgcacggtgaatggtattacctgggtagactctttatttacggctaccagtgccgtatgtgttacaggtttggttccggtagatgtatccactacattcaccacttccggattagttgtcattatcctgttgattcagattggaggattaggagtgatgacattaaccagtttctttgccatgttcttcatgggaaacacctccatttataatcagcttgttgtacgtgatatggttagttccaattcgttaggttcattactgtccaccttattatatatattgggctttaccctagtcattgaagggattggcatggtttcgatttggtttagtattcacggtacgctgggaatgactttggaaggcgagttaggttttgctgctttccatgctatatcagctttttgtaatgcgggtttttctacactttccggtaatttagggaatccgatggtgatgaccaatcataatggactgtttatttctgtttctttgctgataatcttcggtggtatcggcttccccattcttgtcaatttcaaggatattgtattatatcacctacgtcgtttctggaaattggtccgtacacgcaaactggatcgtcacaaaatgcagcatctttataacctgaatacgaagattgtgttaatcatgactttcctgcttttattaatcggtacattagctattgctgcttttgagtggaatgcttcttttgccggtatgcctttggcagacaaatggacacaagctttctttaatgccacttgtcctcgaacagccggttttagtagtgtcgatctggcatcgttgagcgtgcagactttgttggtttatctattcttgatgtgggttggtggtggttcacagtctacggcaggtggtgtgaaagtgaacgcttttgcagttgtggttctgaatcttgtagccgtattgcgtggtactgaacgggtagaggtgtttggcagagaattatcttacgattcaatccggcgttccaatgcaacagtagtcatgtcattgggagtgtcattcatttttattttcacattgagcatactcgaaccgggtgtttccatcatggcattgactttcgaatgtgtctctgcacttagtactgtgggatccagtctgaatctgacccctcatttgtgtgatgccagtaagttgttggtatccttgttgatgtttatcggacgtgtgggattgataacattgatgttgggaattgtcaaacagaaaaagaatacaaaataccgttatccgagtgataacattataataaactaaagatatgaagtatattattatcggtttaggaaattacggccatgtgttggcagaggaattgtctgcattagggcacgagattattggtgcggatattagtgaaagtcgtgtagattcaatcaaagataaggttgctacggcttttgtcattgatgccactgacgaacaatcattatcagtgttgccattgaatagtgtggatatagtaattgtagcgattggtgagaattttggtgcatcgatacgtgttgttgccctattgaagcagaaaaaggtttcccgaatctttgcccgtgctattgatgccgtacataaagcggtgcttgaggcttttgaacttgagcgaatcctgactccggaagaagatgctgcccgcagcttggtgcaattgcttgattttggaacgaatatggaaggattccgcatcgatcaggattattatgttgtgaagttcacggttccggagaaatttgtaggatattttgtgaatgagttgaatttggatgaagagtttcatttaaagatgatagggttgaagagagccaataaaataaccaattgcttgggcatttctttaatggagcttcatgtaaagaatgaattaccggcggatgagaaagtggaagagggagatgagctggtttgttacggtagatatcgcgatttccaagctttctggaaagctatttaatgtgcaaaatctagtggatttcaagatagagggatgatgatatttgttggtaaatagtataatgttggcagttatcccctttggttttgtctgattattgtaattccggtttgcaattattaattgttgcaggatgaagttttatactatatcctatagaggtgaaattgagctgcacaatcaggctttgtgatgtttccggttttcgttggtcgaacacgaagttgcctagactatagaaaataggcttacctttaaaatattcttctttctgaatgacatgcggatggtgtccgatgatggcatccgcacctgcacggataagccggcgtgctccttttcttctgtctcgcgtttcagatatcccttaaaatccagaccaaaacctctccatgcatattccgctatcagaaattttccacttcgttcccgttccacggtgcgtatcaatacaggagtatgttcacgaatcactctaaaatcttccaaaggttgtgctaccctcgaacctaaccaaagtgggcggatatacgcttcatctgcaatccggtaaataaataaccgcttgtcgggtttggggtcgaatcgggtaggcttgataacccacacaataatttccggcatcccgtctcctgtaacatctccataatcaaattgatagacaggataaggcaatttccaaacagagtgggagggttggtctgtattcaaatgaatgacatagagcgaatcagattctttgttcagagatacttccatgtgtctttgattaacttgccattcaaacctgttttctttccggcatgaacagaacatcagtaaaagacctgtaaaaataaggaagtgaatcctgtgtgacatatctgtaacgttttctttggcaaagatagatattaacctgtatttacctgcttcttttctcgtaaaagtgaaaagtccagtatattatatatgaaaaccaccggacttctctttagttaagaaatccggtggcttatcagattttataaagcgtataccttatttcgtttgaatacgaatatttccggctttcactccatttgctttggctgtaaatacaatttctccggcagtttcaccagcttgtatgatagctgtcaacattccgttgaaagcatgcatcttcggaagatgaaattgttccagatttgtcgggtcgccattggcagcggcacgatatttaccggttccctttgcagagaagttaatctgacgattatcagtagggcaggggttaccatctttgtctacaactttcacagtcacatacgctaagtcttttccgtctgcagtcaattcgttacggttgctgaccagttcgatatgatgaggttttccggcagtacgaaccactttttccgctacagcttttccttctttgttataggctactacttttacttctcccggttcatatacagcatccatccacatcagacgatagcggttcttcaacgaactattattcttgctttgtttaccataacttttaccgttgataaacagttcggctgtaggatagttggtatatacaaatacaggagtcacttcgccttcacgtcccggccatgtccagtgaggcagaatatgcaaggtttccgcatccttgttccatacactgcgatacagataatagcggtctttaggcagactggcaaggtcgataataccaaacatggaactgtgattgggccatgcatccgtgtcataaggtgatggctcgcccagatagtcaaatcctgtccatacaaattgtccgattgtccaatggttatcgtcggccagtgcaaagtcctcgtccggaatatttgaccaggaacaggcttccacatcataagaggaacactgatggtcttcatacttagtacttttcttatcctctaccgggaatttgtataccccgcgtgaactgacagtagaagcagtttcactacccagaatcagattctgcgggagttggtcataagattccttatagcgttgggtacggtaattaagtcccggaatgtcaatcattgctgcaaatccgttcgcaagtacacaagtaacctgatccattccacaagtgacaggacgtgtcggatcttctcggtggcaaatgtcttgcaggaatttcgccactttatagccgacagggctacattgggtcggtacttcattaccgatactccacataatcacacacggattattccgataattatggagcatatttaccatatcacgttccgcccattcattgaaataacggtgataaccgttttcgcacttggcaatgtcccattcatcgaacggttcaatcatcatcataaatcccatttcgtcacacaatgctacgagttcgggagtcggcatattatgagaagtacggatagcgtcacatcccatatctttcagcaatgtaagttgatggcgaagcgctgccacattaatagcggcacccagcggacctaaatcatggtgattacataccccttggaatttgcgatgttttccgttcagatagaaacccttatcagcgatatattcaatgctgcggataccgaaacgtgtcgtgtaagtatccaccagtttatcatctgcgtaaattttggaaacagccttgtagagtgacggactttccggtgaccagagttcgggcgcatttacaataaagttttgttcgaatggttgtccgtgattaatgcggctcgtattctctttgctggtaaccacttttccgtccggagaaagaatctctgtctctatacggatttgtgttttctcaccggcattatcaatcttcgtttgaagacgtacggctgcaaagtccttgctgacatgaggagttgtgatttgtgttccccatacaggcacgtgcactttatcagtcacgatcagatgcacattacgatacaaacctgctcccggataccaacgcgaggactgcggacgattttccaaacgtacggccagcgtattattctttccgtctttgtttaataaagacgtcacgttacagtggaaagagttgtagccgaaaggccagaaacaagcttcttttccatttacatagacacgtgcttcgctcatggcgccatcaaagagcagcgtcacctccttatcggcaggagcatcaaaactggttcgataccatccggtgcctacataagggagcccaccggtacgtcctgttttcaaggaagcctttttctcgaagttctgtgttacagctacattctgcaggtcattattcatatcgaatggaccgaaaatcgcccaatcatgcggaataacaaccgattcccatttagtgtcatcaaactccggctggctagcctctttaaaatctcctttactgaatttccagtttttctcaagcagcgtctcactgcgttgcgcttgcaatgtgcaagcggcgcccatcaaaagtacagctaataactgtttttggtgtttcatgttcatttttgcttttcaggtataaaatattttggattcggggtaaagttataaaaaatgattcaataatcttatctcttgaaagcattaaatgcgctggtcggtttaccactgtcgtcaaacatgccttttccatagttcttccaaccaccataactctgcggttcccaagagaatacaccaaggcattgttccacttgtttggccttcgtcataaagtctgtgaaaaagtcttcagcttcggaatagtcccagggaataccaatttcgcacatcatcaccggagtgttgtatttggcaatcagacttttcatattggcaatacatttgttgttcatatcttcccaatcatcggctgctccctctgtcgggtacatatccggataaagagacatgccaatgacatcccatttggcattgttgtcatgcaaataaccgaaaatccggttgtatagattggcatcatttccctggtcgaggtgtacaatcactttcgcattcggataaatctctttaacagcattgtagccggagttaatgaatttcgcaaagtttttaataccgtcactactcgttgtttgtccggtggggaatagcatgccctgatgagtttcattacccacttgcacccattccacatcaatacccatctctttgattgcaccgagtacatctttggtatggtcggcaatcgcctgctccagttcttctaccgtataattttcccaggctttgggtttggcttgctgaacaggatcggcccatctgtcactgtaatggaagtcgatcatcaggcgatagcccaaattgtgtgctctccatgctttgagcaatacgtcacccttattgcaccagccttttacatcttccgtgtcattttccgggttcacccatacacgtagacgaattgcatttatacccaggtcacgaagcagagacatacattcctgttcttttccatcggaggtatagaatttatatccggaactttccatttccgacagccaactgacatcagctccccgggcgaagccggacatatcataagtggtttccgtcttttccgggaaagtcggagtatcattatcatcattacaagcggtgaagatgcttccgcaaagtagtgcggaagctatcattatatattttcgtatcatagtgattctgttgaatttaataatcatgttgttgaacttagaatgttattcagtgatttcagtcattgtaaactccatcttgttgagatccaacgtaatgagatatttaccctccttggcgggttttatgttatcaccattttggtcacttagatagagcccgctttcagaagtatagtacaatctccagtcccagttaatctgatcgggattcgtattcatgaggaagtagaatccgtcaccgatagtggtgatatcacattctgcactccatatgccggtttcctcattatatatcatcaggtctttagccgttgaccagccattgaaagttccatatacattgatttgtttgatttcagtaggcttccaagtcaagttgacataatctacttcgattgtataacttttcttgccggaaccatcgaaccagatgttgtaatgctctcctgttgtaagagcaagactataaagattgttgggatcagaaccataccatgtatctgttgatgggtctactatctggaagttttcatcgctgacggtttggaatacagtgcgataagttcccgcagttttaccgggttcaagtttgcggtataactttccccaccatgagtcggcaccttgcatttccagataagagggataagtcggttctacacttcctccttccgtcacttccactttccatgcttgcgggtcgttcaggtcaataatcaatgtacattctccggctgctggtacgtttactgtaatatttctggcagaaacattcgttccagtattgaatgtcaattcattagcagaaccactaaaggcgaaagaagtatctttggctttcgtatcgtcaatgctgttatcagctccgctgacgctggtgttatcatatagtttacctgttccattcatctgaatattgatagtgccagctcctgtagcagtaaatataccctgccattgattcttgtcacgtttgtattccatcgtaatacctccgtcgatgccgcttacattgagtgttggcatccataaggcagtccatagttttttggtggtattgacattcgtatagtaacagcctgattgaccggggaaccacaaatcccacgttccttcagcagcatcagttgtcaggaagaacggagtagccttactacctgatttggctgtgtgccaaacagtaccatcggcttcctgtagatagaaaccctcccaagaagtggctcccataaagccgatatagttgccatccgcattggctgcatacagatcttttcctgaatccttgccgtctcccttattgataatattggcaaatcgcatatcaatttcataaggagtaaccatgacttttaccacattactgtatacaggagcgatgttacttccgtttcttccggcaagccggaaatagagcggtgcttcttcttcgggagtagctttcaactgataagcgacgatatttaaggcggagacagagtacgtctttgatactccactttcggtcgtttccagaatctgcccggagaaatcttccgtgcgtgaaacctgtacggaagtttgtacaccgctggtaggctggtatcttgaatcgctcacttgcagcgtctggtcagtccaggcaagcgacaaagcataaaacttagctgtctcctttgtcagtacgacagaactggcagaagctatcaattcgttctcttccgggctggagagaaaataggtatccccatctttctcgcaagcacctagtaataggagagcggaaagtaaagtgaatagattatttagttttttcatatcgttgttccgtattaatatgattaatagttttcattgtataagtttggattggccgtcagttcggtagcaggtatcggatagatattgtatttgctctctactgccttaccgtcttttacgccacctttccattgccatacatagctgttggttgtaaattgattgaagcggatcaagtccgtacggcgatacccctcccaatacagttcacgggcacgttcgttgatgataaacagttcgttgatttcagactcgcttttgttatgagtgttgtcgccgaaagcacgttcctgtagctcattgatataaggcagtacatttgccagagttgcttccgttcctccacgtaccacagcttctgccatcattaaatatacatcggccagacggaataggggataatctgtatttacaccaccgtctgcggtgttggaagcagtctgtccggcatcagtcaggttagtccatttttctacgaaatagccattgctttggtcatctatcttttccaggtcccgggtttgtccgtcggtaaagaacatatatcgctggtcggcttcttcgttaccagagaaaagttgaggaatttctccgcgtacacggaacataccccatcctgattttacaccgtaatcttccggtatctgtttttcggacgtgttgctcactgcgccacaaacaatgtaagtggatgatccccatgacacgagattggttgcgtctaccgggagggtgaagattatttcgttcgtacgtttgtcattgtcagcattaaacagcttgtaataatcgctttccagttgataaccctgttcgataacctttttacaggctttgatacattcgttgtatttggaagtctgggtataaacttccgcattcagatataatttggcaagtaatgtatatgcagctccttgggaagcgcgtccgtaaggacagttcgctttatttagcatttcatctttaatgtcattcagttcactttcaatataatcgaaaatctgctgggctgtatagcggggaggcagatatccgactagcgggtcattttccgtcacaaacgggatattgcggaatagatcgagtgcgtgatagtagaataaggcacgcatgaaacgggcttcggcacgataaatgcgaatttcagtctgctcctggtccgtgaactgtgctatcttttcatcggtggcattgcggagaaactcattacataaagcaatgttataatagatacggtaatacatatccgatacccaaggatcgttagcgtcccaactcaaatacgtcagtcccgtcacgttgtcaccggacagccaggtagaagccacttcatccgttccacattcctgcaagttgaagaagcagcgcatataatcctgtccgctgttactactcaaatcgttgttaccattcttttcctgtccggtggtcaccatggctgcatagatttttcccagaacggctttatagtttgcagcactggtatatatggtagaagatgtttcttcttcgtgtggatattggtccaagtcgcctatgcaggaactcatcaggagtgcgctgcaaaaataaagggctgtataaaatatctttttcataatcgatgcttttagtaattagaagttaatacctatgttgagagagaaagtacgtgggcgtggataaaacgaattgtccacaccgttgggaatttccgggtcaacgccgctgtatttggtgatacagaatacattttgcaccatggcactcacattcagactgcatcctttataaatagtgccgaagttgtaacccaatgagagattatccattttcaggaaagaagcattctctacatagtagtcagagaggtattgacgtgtctggaatcctgttttcaggtaggttgatgacaggttgttcagctggtaagagttgtagctgacagtttcccaggcaccgctgttcatagccatcgcgttatagacatagtttccgatattggcacgcaggctggtgctcaatgtccacttcttgtaacgcaatgaggtactgaaaccgaggatatagtcgggagccggagagtggtagcggtacaagtcgttcgagttgatttgtccgtccccgtcgaggtctacgtaagctccctctaccggtttgccggttttttcatcatacagttggtggtaaacgtagaacatataaggagcatatccctcgctcagtgtctgtacctgataactgtcgatatacggacctacggaagtgttggtggcaggcgtaccggctgtcagtgataagtttttcactttcatcttctgccatgtcatgttgaaactcaaatcccagttccagtccttggtctgtatgggcgttgcgttcagactgaattccacaccctgactgtctacatttccgacattggtcgtgatgttacgatcgaatgtagtaccggcagcagcaggtacggtggcaatcaggtctttggtctgacgggtgtagtagtcgaaactaccggtgatgcggtctttgagaaaaccgaagtcaaaacccacattccatgaagtggttgtttcccatttcaggttgggtacatacgctttggggcggtaagtaggagtcggagtgccaccgataagagagccggcaccactttgactgatcgtatagatagggaggtagttgtagttgcctataccgtcttgctgcccggtgacaccataactggcacgcactttcagcgtactgatgactttattgtctttcaggaatgattcttctgtcactctccatcctaatgctactgacgggaacgtaccccaacgtacatttttagcgaagcgcgaagtggcatcgcgacgtacagtagtagtcagcatatagcgggagttgaacgagtagttcaaacggccataataagagagtaatacatggcgttcgtcagaggctttcgatgttttctgtatttctcccaacgtgttcatttcgctgtaaagcggagtcgtggatttccagtactgataatcgtaaccggctgtaacatcaaaactactcttaatggattccaccaatttgttgtagttggcatacagagtcaacagacggttttcttttttctgtgggccatagctgtaatccaaaccggaagtggtgtaattctgtgcagcttctgccggaacatatacacttcctttaccttgtgcatagtcataacctaacgtagcatgcaacttcaaatcggggaaaaagtgaagacgatagtctgcatcaatgtttccgataaaacgttttactgtactttgtgagtcattcatattgagaagtcccaccggattcatgactgctccgttcacgggagcaccggtgttgtcaatcgcttctgtatatccgccgaatgtgtctagacccgaatatactggaatggtaggattcatggtcgaagcagcccaaatggcacttgtattggcaaatgtgttcttattgatagaacctttagcattgatattcagttttaagtggtctttaaagaaagacggattcagtgtgatgcttccggtgtaacgctccgcgttgtcagtacgtaataaaccactctggttgtagtaaccgatagatgcacggaaaggtaagtttttggtaatctttccagcaacacttagattattgtccgtaccgaatgcattctgatagatttcatcgttccaatccgtgtgtgccgtgccgagtaacgcccgttgcgcatcggttcctttgctttggatggtattgacaaattcatcgtagctcaacatatctgccaatttggtgcgggtttgtacagagttggtcgtactgaaagtaaatttcagtttatccgaactacctttcttggtagtaatcagaataaccccgttggatgcacgcgaaccgtaaatggcagtcgaagaagcatctttcagaatggtcatactttcaatatcgttcgggttgatgaggctaaggaaattcccgtcattaccgctgatgcctccctgttccaaaggaacgccgtccagtacgatcaaagggtcattactagcgttcagtgaagcaccaccacgcacacggatcgtgcttcccgcagtgggagaaccactgttggacatgatttgcacaccggaaatcttaccattaatcagttgctcgggagagctgaccaatcccatgttgaagtccttgctgctgacgttagttaccgaacctgtcaggtcacttttacgctgcgtaccatagccgattactacaacgtcgctcaatacctgtgaatcacttctcaactggacattcaaagtagtactgttggcaggaactggtactacctttgtttcatatcctacataagagaattgcaactctttgctgccctgtggcacattgagtgtataattaccgtcgaaatcggtcactgttccggtagaagtaccgacaatgaggatacttactccgatcatcggttccttgttctcgtcaatcacttgtccggtgattttcttgcctccttgttgggcgaaggcaggaatgatgcctcctaaaaaggctgtacacaacataagtagtacagtcagatggcgtagatttaagatattcctgttcataattactgtgttattgataatagatttatttttactttttatttaaaaatcagcggcttttctctttctgtcccttccgtttgctaccccctttcagaaggcttcagacgtggttcagacgaaagatttgttcctcaccgaggaagaccttgttcctcaccgatgaacgaccctttcctcaccgaggaacaaaggcttcgacaacggggaactttaagaacgattattccagccagatatttcctagttcaatttcaactaactctttcttgtttcctgacattgatagctccagcttctcaatcttttccggtagaaaagcgatttccgtttccggatggaaatactgtttcaagaatgtcggataagctatcggcagcagtaccgtgtctgtctggcgtaaatctttcaacggtatccgtatgattccctccgatgatggagcaggacaagggcttttataagtatatccgtctgacgttacgaaaccggcactgagtccttccggaagtgctttcgtgcgatttacccggatacagagaacgctacaatcctttactctttcttttctttcttcaatcaggttctttacgaacgtgcggaggaaatagtgcggattttctcctttaggagtaaaccggaaccggagcaaaggtttttccaccggagaagaatcaaccaaagtacgttggagatcattccattcgggaagcgtgtatgcttctatccggctatctgcgtccgtaatagtcaatagtggtatcgcactatctggggcaacaacacgagtagtccaataggctccggaagtataattccagtccagtggattttcctttattcccgatgatgaattcctgtaaccggaatttcctgtgggataagtgcgagtgctgttgccccggcatacgatgatgttatacctgaaacaatcatcctttatttctctagcgggtatcgttgcctgataggtatatccgcctgtatgtttcatcttgatatatggattgtgctcattccaaaaagatatcttatcggtgtagataatcacagaatccgggaattcggttcctaccacctgtgcactaatcgtcaaatctttatttgcttcagtggttgccgatggagtatgaacgactttataatccgtcacacgtggagcaggagccacatattctccgatgcggatggaattccattgagagtctgcctgccagttctgtttgggcgtacagtttttacgtttcagcagataggtacccggacaaagtccgcggataatcccgtctgtcacatctcctttctgctgatttccttgattgagggccgtaaaggtaaattccatccctaaatcaggtatttgaagagccatgtcccaagcaccataagcaatggtaaccacttctttatcgagtgacggtttggcaaacggatcgttcaccactaccgcgtccggcatcacttccagtctccagactcccggttcgaggcaatccatgaaataagtacctgttccctcataacgaataatcggagaactgccacaaccggcaatggaaacaagttgtgacgcatctttgggctgggtgttggtatgattggaataatagaatttctttccattatttaattcgctcaagtcctctgtataactgacacgaaaaccgtcaccaaataaagtgtcctgtggataactgccgtatgattcacctcttttcagactgcgtgcagcttcggcggctatcttcatactgatagctttatgaggcgtataggcaagattcaagaaatgagtctgatattccgtattggcataagcaatatccatcggatcatacgcaaactgggtaatccattgaaaacctgctgtacggaaagtacgtaccatggccggatacatataagaatacatgatatctgccggatcgaactcatataccatccgtgttttcttatcgaatcctttcactttatcggaaaagggaatatcatagcggtctatatagggaaggaaatttccctgctgtgtctgtccggataccagtccgatgggataccattgataagtagttccctgaatggcagtttcgtaataagcctctactacatatccgttgtggcttacattatagaatacaggtttgcggtttcctgttttattgatcgctttcagcatccggttaatataggcttttacctcttccttcgtaccggaatgacaaggttcattattgatttcgaatccaacaatggagggatcgtctttataagctaaccccgtatatggattgacgtgcttcaccaaaccatgaagataggtttcttgtgcagcgatagcttccgggtgggagtgcatatcgcatttatcatatttataggagaagccgcccgtctgtatgtttcgttcgggatatccgttcccgaagttggtctgcgcggtaatcacaatatgaatattgcgttctttgagtttggcaatcaggtagtccatcaagtcgagatgctcgttttcgaggagatttccctgtccgtctgtcagttccacatcccataaatgaatacggtaagcattcagtcccagacgggagatatgatatacatctttgtctatagcagctttgcggtccagttccaaatatccaatggcacggtaagcatgggcgaaaggcagcgtataattaacaccgaaaaaggaagcctcccggcgggtgtcactccaacgcatcaccccatttccatctatatatataataggtgtagaggatgatttgccctgcactttgacaaaggcagatatcaaacaaataaaggtaaggatcaatagtcttttcatgctatcaaatttatcggtttattgacagcaacaaaagtaatttattggtcatttcaataaaagcacagattggacatataaggataaaaataggacgaaatgccccaaaatgcctctacaggtcttcattaaggtactggcgtggcgtttttccgaattctgcctgaaaacatttggagaagtaagagtgattggaaaagcctaccatgtacatcacttcggcaacggtaaatttcttttgttgcaacaacatggccgcctttttcatccggatcgatttgatgtattccactggagacattccggtcagctgtttgatttttcggtaaatctgcttattgctgataccggataattcacaaagtgcgttcacattcaattccgattcagaaagatggtcctcaatcaggcggataatgttcgacagaaatttctcatcttgagattctgcttcgattggtttaagaacaggcaacgattccaactgctttttcacctgtgtcgccggaatctcttctttctctacggcgatgacagggatattcaggccaatggaagttccttttccttcgttcgaggtgactccgttaatgtgaccgccatgaagttccgtataagtcttgaccagataaagtccgatacccgtaccttccttattgccggaatgtggagactggaaaaagcgctggaagatatatggaatatcttgttgcgggattccgcttcctgtatctgaaacacagatatccaacaatcccgtttcttcacgatagaaaagagacagacggacgcttccgccatccggggtgaatttgacggcatttgaaagcagattatctaaaatcactccaagtttgatggcatccatatcagcataaatcttggctttattcgtctcgaaatggaatgtgagctgtttgttttcctcatagacggaaaacaggctacggctgaatgacacaagttcgatgcgcgacaaaatcagcagtgaatctttattatcctctatccggttgaagtttaatacctgatgaatcaatgagtttattttcattgcattacgttgcacctcctccagtgtctgtttctcatgcacttcttctgcaacggggagcaattggctgacaggagcgataatccggctaagtggtgtctttaattcattagacaaattggtaaagaaagccattttctggcgtgattgctccagaatcttctctttttccatccgttccattttcagacggttcttgacacgaaaaaagttgataacccaggcaatgaggctcaagaataaaagaatgtagactatctttgcccaaagtgtgtaataccatggagggagaattttaatattcaggatatatggatgctcggaaggagaaccgctcttttctactttgctgattaccagctgataatccccataacccagattactgtacgtaatgcgattcgtgttggattgcaggaaattccattctttgtccataccttccagccggtagacgaattcatgtttttcttccagcgagtaggggaggtctgaaagttcgaaagccaggttgttctggtcgtattttagttcgatagcatcggtatagcggatgttaggaatattctctccggtatgcggagacatcagttgattgttgatatataaggcagtcagtaaaatggagtgttccggctgactcatggcttgtatttcgggacgggatatgccgaacccgtctgcacctcccagatagatatttccatcttccggatcaaacatgagactggtgaaacgtttatccgtcaggctttgctggcgggcatccattgttctccggtcgatgatccagagtccgttagtggtggaaatccagatatgttcttttacagaggtcatagacagaatctcgttattgctgaaattgccgaaagagatactttgctgactcgagtctttgggattgatacgcatcactcctccgtgaaatcctacccaaagcatgccgtcttcatcccgtaaaaggtagttcgggctcttctcgccacttaattcatcggcaaacagctttgtcacttgtcgcgtacgggcattgattttgtctatccctttgctgttgtataacaatacccatacattaccttccgcatcagggacaatctgattaatgaacatccccgacagcccattatggatggaataattttgatcggctacatacgatcttccggcagattgtatcagtttatgtttgtccacaacaaagatacctccgagacaggtggcgatccaaagcttcccgtcagtatcttcaaacaggtaataagcccagttggtattataagttcctgtactgtctacgatgttgtagtgtacaaattgatgggtattatagtcatagcggttgatacttccgtctgtggctatccataactgctgttctctatcctcgtagatgtgccgtatccggttgtgggataacggatagtttttatcccccattctataccagatagcatcgtgtttattgcctgccggatgggtgaaccggatcactccgtttgtacctccgaaccaatagaatcctttagaatcccggaacagggaatagaactgatttccgtctcccgtgcctgtgatttgagaaatcggtacaaattgcagcgcactgttatagcgtgacagggaaatgccataatctgttcccagccagatattatgttcctgatccgagaatatgttccagataatattgttggttagtgactggatattgcgtgaatcgtgaatgatatgctgcaaaggttctttgtcattctggtacacataaagtccgttgtctgtacctgccagcaaattttcatctccgtccagtgccagtgatttgatggagttgttatgaaatacctctatcgccttcatctctcctgtagtgggattgtattggaagagataaccttccatcccgatccagatacattgtcgggcggcatcttccaacagagaattgacaaacaaattgctgcctcctcggttaactggcaaaaggatgttttcaaattttccacttgcctgtacatagcggcataatccgttgtaagtacctatataaatttgattatcttttgtatgaatgatggaatagatggtgttatgaggcaatccggtctgtttgctatcgaaatgattcagttgacggctttttaactgataagtatataatccgttcaacgaacctatccacaatgtatctccctgaagtaccatggtacggacatccgttgggaaatcagtatccggttgctcatatttgtctgttcgatagttataaacaagaatcccgttatctgttcccagatataaataggtgttatctgctataataccgcagtagatacgtgtgttagtacgttctccatacgtgaaatgctgttgtgtggaataaccgtcataactgaataaacccttgttggaacctacccatattagtccctcgctatcttgcaggaagcaactaatcaccgaagcttcggccccgagatagatgttgtcgaattgctgataatttactttttgcccatacacattgccactgctacagtaggcaaggatgagaaaaagaattgttgtcattcgttcgcgcatggtgttaggtttgcaggtttttaaatctgtaattgttgtaaaagtattccttctttcctgcaaatgtaggaaaaatgtcggttacacttgtaaatatcccgctctttttgttcctttgctatctatttataaacagaaaacttacgtatgagaaaactaatttattggcttttattgccgttggcagtggctgtgagtgcatgtggcggtaaaaaaggatcttcagataatacgtcgacattggcgatgatagacagtgtggatgctcacggattgcagcgtatgcagacgtctaagagcgaaaccgactttaagtttaaggggaaagattatcattcccttgtttcgcgtactccggatgaaaatttgccccatgtgacaaacgagatgggagatacctatgtcgacaataaaatagtgttgcacctgacgcgtggtaacgaaaccgtgttgaacaagacctttaccaagaatgatttttcatcggtagtcgatgcgaacttcctatctaagtctatattggaaggcattgtatatgataagactactccgcagggaattgtgtatgcagcgagtgtttgttatccgcagacagatttgtatatgccgctttccataacgattaccgctgatggaaaaatgagcatacggaaagtggatatgcttgaagaagattatgacgatgaagcacctaattaagcttgtaggcgggtgttgacagtaaaattacacaaatgtgaaaacatttgagacaaaagaaaggcagccaatgaggttgcctttcgtatttttgcaccgtcaacaaacttaataccgaatagaatgaagaaaaacatttttgctatctgtgtggtagcagtaggatgtacggcactgaccgctcaaccccaagatacacaaacgttggttccgcttacggaacgggtaaacgtgcaggcggattcggcacgcgtcaatcaaattatagacgattgctgggtagcagtagggactaaaaagcctcatgcaattcaacgcgacttcacacgtatgttcaacggtaagccttcctatcgtttcgaattgaaggaagatgataacactctgtcaggatatgccaaaggggaaacaaaagggcgtgcggaattttcttattgttatgcaacttctgatgatttcaaaggcctgcctgccgatgtttatcagaaagcgcagattaccaaaaccgtatatcatcatgggaaaggtatttgtccgcaaggagcttcccgcgactatgagttttccgtatatattccttcttcattgggtagcgatgtctcgacaatttttgcccaatggcatgggatgccggatcgtacattggtacaaactccacagggcgaagtgaagaaactgacgattgacgagttcgttgaactggaaaagactacgatctttaaaaagaatgaagggtacgagaaagtagccaagctggataaacaaggtaatccggtgaaagacaaacaaggaaatcctgtatatcaggccggaaaggccaacggatggctcgtggaacaaggaggctatcctccattggcgttcgggttctccggtggatggttctatatcaaagcaaattccgaccgtaagtggctgacggataaagacgaccgttgcaacgcaaatcccgaaaaaacgccgattatgaaacctgtgacatcagactataaagcatcgaccattgcttacaaaatgtcttatgccgattttccgaaagactgctggattacattccgcattcatatcgactggacagtctatggcaaagaggcggaaacgattgtaaaaccgggtatgctcgatgtgcagatggactatcaggaaaaggggaaaaaggttagtaaacacattgtagacaatgaaaaaatcatgattggacgtaacgacgatgatggttattacttcaagttcggtatttaccgtgtaggtaatagcactaagccggtatgttacaatctggcaaactattcagaaaggtaattagtcagaaggtaaaaagagagtgatatccggatgttctttttgtgcgcatccggatatttttttagttcttttaccgtttatttgtcagcgcagcaatgatagtgataccatttttactgtcataatttgctgattgtaataaagttaaaaatgataaaaaataggactgcatctagtaagtacgtgtcaggtatgcaaaaagatttgtttttttgccgcttgccaaatggcatatataaaataactagtgatgcaaatgatgaacaaaaatgggtttagccgatgtgcagagttctacatcggtcgtttgcgaaaggaaggaaggcattctacagcgcatgtctataagaatgctatcttctcttttagcaaattttgtggcacgtccaatgtgtcgttcagacaggtcacccgtgagcgtttacgacgttacgggcagtatctttatgagtgtggcttgaagcctaatacgatttctacgtatatgcgtatgcttcgttgtatttataatcgaggagtggaagcaggtagtgcaccttatgtgcctcggttgtttcatgatgtttatacgggagtagatgttcgccaaaagaaagctttgcctatcggtgaattacgtagacttctgtatgaggatcccaaatcggagcgtttgcgtcgtacgcaggctattgctgccttgatgtttcaattctgtggaatgtcattcgcggatttagctcatctggagaaatctgctttagatcagaatgtgttacggtataaccgtatcaagactaaaactccgatgagtgtggaaatacttgatactgcaaaggaaatgatcaaccggcttcgtagtaaccaggattctcatcctgattctccggattatctgtttgatattcttagtagtgataagaaacggacggatgaaagggcttatcgggaataccagtctgccctccgtcgattcaacaaccgtttaaaggacttagcgagagctttacgtttgaagtctcctgtcacttcttacacacttcgccattcttgggcaacgacagcgaagtatcgggaagtatcgattgaaatgattagtgaatcattgggacacaaatctataaaaaccacacaaatctatttgaaaggcttcggacttaaagaacgtacggaggtgaataaagggaatttatcttacgtgagaaactgttgtgtagacagatggtagatatataaaatattgataatcagaagtaaaatatgtgtgttacttcttaggtaacagaacttaaatttgacgcaaagatagacaaaaacacgaatagtaagcaaatattcttccattttttttcgttttatctgaaacatagagcaaaaaactgtctgaacatgaaataatcttatttccatgctctatactttttcattgcctaattcaatagttttcttattgaatattaggcttttccattttctacgcctttgtcatgtatgtgatttctattttcactgtagtatgcgtttcgtgtatgtattgtctgttacctaagaagtaacagatgaacatggggtaaaaaaatatgattttaacgaaaccaaaatcagtaaatgccgggcctagtagtgggacaggggaaggcgtagcacactcaaaacgcttatagcagaactgtaaaatataaaagaggttgtgccaacgttttgacacaacctccatttttttacatttacttctgttattacttcttcgaaaatagtgacggtatatgcccgggatagtgacggtatcggaccaagatagcgtcactatttgtcttggataccgtcactatcttacttttattaaattatactccgtagtatttttagttattctctgttttataggtgattacaaaaatctattccatacgtctactatgtaaatcgtatgcaataaaataaaaaatgagaagaaatttatttaaacatatcctttggatattgatacttgcagagtgttttcctctattggcaattgccggatcgcagcaaaaggaacaacgttataaaatagccgtatgtgactggatgattctgaaacgtcagaaaatcggttcattccaattggtacatgaattgaatggtgacggtgtagaattggatatgggtggtcttggcaagagggaaatgtttgataataaattgcgtgagccccatttccagcagttatttcgtgaaactgctcaaaaatatcaattagaagtttcttctattgctatgtccggtttctatggacagtcttttctggagcgggctaactataaagatttagttcaggattgccttcatgccatgaaagtgatgaatgccaaagtagcctttcttcctttgggaggaatcaaagccggatgggaaaagattccggcactacggacagaagttgtaaaacgcttgaaggaggtaggagatatggcagcttctgaaggagtggtgattggtattgaaactcaactggatgcaaaaggagatgtgaaactactgaaagaaattaattctcccggaatcaagatctattttaaatttcaaaatgcattggagaatggaagggatttgtgcaaggagctgaaaattctggggaaaaagaggatttgccagattcactgtacggacacagatggagtgactttaccttataatgaacgattggacatgaataaggtgaaaaagacgctggataagatgggatggattggatggctggtagtagaacgttcgcgcgataaggatgacgtgcggaacgtgaaaaagaattatagtacgaatattaagtatttgaaagaggtgtttcaacagagataggaggatattatgatatagttaatattacaaagagagagaaaaaaatgcaaaatctattttttttattcttttaagtgattacatattttttgattgtacgtctttccttaaaagatcttttagattttgaagatataatatattatttttgtttaaattaaaatttaatctatgaagagtaaaatgaagattaaaatgaagattgccggaaagttatggggcttgtcagcaattcttttattcgtttcttgtgctaaaggttttgatgataatgaaaccttttctggaggtgtgacaaatgcacagttggaatcgccggttatcgacgataatagcttttcaaccttaacaaactctgatggtacagaaagtgtaaagataacgtggccggtagttatgggagctggaggatatttgcttaatgtagatcttatagaagatccggcagaccctacagttactacagagaatcctgttgttgtgatgcaagatagtgttgtagatggttcatctgttgtatttacgaaaacagaagatgctacctataaaataaaaataaagacacttggcaatgaaaaactgaacaataaggaagcacaagagagtactgattttaaatatgttgcattggtgcctgctacaacaattcctgtaggtgaagatatagctgaatatattaataatcaattgaaagatagtgataaagaacaagcttttgctttggaagcaggtaagtcttatgttctgaatggtattgttgattttagattgaatgtgattacacttcgtagtactgataaagataatcgtccaacggtaaaagttggagctagcggaggatttatgacgcaagctggattgaaaattaaattcattaattttgattgttcagaaatgactggtgctggttttttaactctaagtggagaacctagtgaaacaatatcaataaagagtttaggctatgataaagatgaagctaatcaagatggttatatcatcaataagcctgtaattattcaggaatgtaatatcaaaaatctgcagaatagcttgctttatggtaataaaaaaccatggactttacgtgatttccgtattacagattgcatcgtacagatgaataatgctggctctaatggggttattaatttatatggtgctacgggtacaattaaagatatgactattaagaatagtacattttataatttagtgaaaaatagttctgcttattttattcgttatcaaaataactcacaaccttggaaatattttggcaagagtgataatacttcaactcacattatatccaataatacattctgtaagactttttcaaataaagactttggcaataatatacctaatgataagacctcaatgacacaaaaagttgaatacaatatattctatgatgtatatcgtttatatcagtatcttcaaagtaataataagaaatcaactgttggcaatactatttggggagttgatggtggaactcctaatggcaatgatacaggaggacgaaaagatgataatggtaatccgtttgctacacttgaagaccctgcgttcgtaggtcctttcttgcaggaacttgacttattaaaaactaacggtggtgttgattttgaacctaaaggtgcagaagctgtaaaaaataaaggtggtgaccctcgttggtataaataaatataaagtataaattataatgctataataatgaaacataataatataattaaattgtgccttggcatatttctggctttcacaatggctttgcctgctattgcccagaaaacacagacattcaaaggtgtagtggtagatacgacgggggaacctattattggtgcttctgtgaaggtggtaggtacaactactgggactataactgatttggatggtaaatttatggttgttgttccatctggaaaacaggttgaaatatcttatatagggtatataacacaggtattatcagattttaagcagactaagattgaactgaaagaagatacgcagcagttagatgaggttgtagtggtaggttatggtacgcagaaaaaagcgcatctaacaggagctattgctactgtacctatggatgatattcaggatcttgcttccggtaacttggcaagtacgttgagtggtatggtaaatggacttagcgttagtggtggagatgcgcgacctggtgagaatgctcggattaatattcgtcaaaatgatgttttatcagatattggtggtactgcttcagaaccattatatgttattgatgggtatatttatcctgtagaagtgaaaattggtgatgttacagaaaacttaggagcaactgcatttaataatttggatccgtctgtaattgaaagtatttcggttttgaaagatgctgcggctgctgtatacggtgctcgtgctgccaatggtgttatattggttactactaagagaggtaaacaaggtgcacctaagatctcatatagtggaacttttggcgttgtggatgaggtttcgcgtgctaagatgttgaatgcttaccaatatggtcaactttggaatgctgtacgtgcggctgatccgactgacgtatctattaatttgcaaaatgatttgtttcaggcagacgagttgaatgcaatgaaaggtttgaattatgacttgttggacaaatactggaaagcggcattgacacaaaaacatagtatcaatatgaccggtggttcagaaagagctaattattttggaggaatatcttattttgatcaagatggtaatcttggtaatctggattataaccgttggaactatcgtgctggtgttgatgtgaagattagtaaatggttaaaagcaagtcttcaggtttcaggtgactatggaaagaaaaacaaaccgaatgtgaaggttggaggtagtaatgacgagaaagactataatcttctgttagttcgtccatattatattcctgaagaagtgaatggtattccaatcgtgccttatggtattagcaattcacaggtaagttcttcgcaaaactattcattttctctgcttcaaaacgcaggggattataatagaacagaaacatcgaatatgaacattaatgcgggactggaatatgattttggatggaataaatggttgaaagggttaaaactaaaattctcttattcaaagagtatcaattctacaaaaaacaatcaatatggttcgtcatatgaactttattatatgtccaaacgtgctggaagtggaaatcatttgtatacacctatccaagggcaggaatctctttatgaagagttgctggcagaaaacaatttcttactagctaataatggttctgctataaacaatgccagtggggatccttatttgtctcgtacaatgagccgtgctgataattatcagatgaacttcactgcaacttataaccgtgattttggtagtcatcatataggtgctttgttttctattgaaaaatcagaggctgaaagtgaatatttagtgggacaggttactaatccttatgaatttaccaatggacaatcgaatctagttcaatataatagtgcgtctactacagaatttaaacgtgcagagtctggtacattatcatatattggtcgtgtgaactatgcatatgctgataaatacttgtttgagttcctgcttcgctcggatgcatcaaccaagtttgctcctgaaaattattggggagtttttccttcagtttctgctggttggattatatcacaagaagaatggtttaaaaagagtgtgaaatgggttgattatttgaaagtacgagcttcatttggtttaacaggtcgggataatacgaaagcatggcaatggatgcagaactatgcggttgataaagataaaggacctatatttggtgttaatacatcaacaaacgctggtaatcatataactattaataaagaaatatccgctgtaaaccgtgatgcacactgggataagtcatataaagcaaactttggtttggatttcaatgtgttgaataaccgtttatcattcaatattgatggttattatgagtggaatcgcgaaatgttactcccatattcagcttctattccaggtacagtaggaacacagtctgcgaattttaattatggagagttggacacatatggtatggagttatctgtgacttggagagataaaataggaaaagattttaaatataaagtgtctgtgaataccgggtatacggataataaggtacttatgatggactgggaaaccaatcaacgttatatgaagattcatgaaggcagtcgtaccgatatgggaacatggggaatgcagtgtcttggtatgttccgtagttatcaagatatagatgaatatttcaccaaatataatattacatcatatatgggtatgactaaggataatgtaaaacctggtatgttaatatataaagatattcgtggtgcagaacagaccgacggaacttatgctggaccagatggagttgtaagttatgaaaatgatcaagttcgtttgtcaaaccgaagtaatccttatggtttcactacaaatttgagtgcagaatggaaaggtatttctttgtctgcacagataagcgcaagttggggaggatatagttttgtcccaacatcggcacttaagatcggtaatatggttggttcaggatcgggttcgtatacagacttggaatataccaatatgccatccttctggaatacagataatatgtttgtttataatgatgtagttgatgcgtcaggtaatgtggttgtaaaagctaatcgcaatgcaaaatatcctaacttaagatggggtagtgttaatagtgtgaattcaacattttggagagtgagtggaactcgcgttagcatgaatcgcttaacattagcatatgccataccatcgaagtttacaagattgataggtatcgaaagttgtcgttttaatgtaacaggacaaaacttatttagtttctataatccttatcctgataattttatagatcctatgacttcttatggtagttatcctactttgcgtaagtttactattggtgtaaatgtgacattctaaaaagaaataacgatgaaaagaaaaaatataatagctttcagtgttgctttaatggcgataggtgctttcacttcatgtagtgacgagtttctgcaagataaaaaaaattacgactatgttgacgcaagtacatataatacattcagtggcgcaaaagcacgtgtagatgatatatatgcttggtgcttgcctaatacgagttccgaaccaagttggaaatacaatagtaccggagcagccgatttacagtctaagtctacagaagagtatagtggattcggatcattcgtagatcctgacgctccgatgaccagtcagagtggaaacaatacggttcctgattattttcataatagtggtaataatattcaggcaagtgtttggggacgtattcgtaattgcaatgatgttatttacggtatagagaatagtactctttcagaagaagaaaagaatgagttactcggacaggtttatttctttcgtgcatggtgttactacaacttagtgaaatggtatggtggagtgcctataattacggaagtacaggaaccagtggcaggggctatcactcctcgttctacaacaaaagcgtgtgttgattttatttgtgaggatttagagcgttcagcgcagttacttgctccgtttactgaaaatggaggatggccttcaagtgattttggacgtgttacttccggtacagcactggcattgaaaggacggactcttttgttatatgcaagtccgttgtttaaccgtaaaaatgatgtagaacgttggaggaaggcttataatgaaatcactgctgatttacccagaataaatgcttgtggatatggtttagctaatgaaagtaatgccggagctaatgcttcaggttgggcgaatgttttttcaatggttgatggcaatacagaagctgtattcgtaacgctatataatgatatagccactggcggagtacctgattttagtaaaaacaactcatgggaacatggtattcggccatcaaatgccatgggaggtggtggcaaaactccttctgctatgatggttgatatgtttcctatggctgatggaaaaagaccttctacgtgcaatacttatactacactagagcaatcttctgttgcttatgataaaaatgttccatttgccaatcgtgatcctcgtttttatcggacgtttgctttccctggagtacgttgggctttcagtggtgatcctaagaacgcaagcaataataatccttatacaggggataagtataatttgtggaactatgtttggtatgctaatgagagtgatagagataatgaagaggctagtagctctaatacttatggtgcggataacttgttgacaaatgctaaaggtttctatatacgtaaacgttcggatgatttagatgtgaattcgaatgccagatataaatttagtcaagcaaatggttttaaatttagtggcagcccatatttggagattcgttatgctgaagtgttgttgaattatgcagaagctgcatgtggtgctggtgaaatgggagtagctgttgaacaattgaagaagatacgtgctcgtgtaggatatacatctgcaaataatttcggtttacagaccaacttgtcaggtgaccaagctgcatgttttgctgccatcttgtacgaacgtcagattgaattggcttatgaaggaaaacgttttgatgacttacgccgttggatgttgtttgatggtggtgcagaaagagcagaaggtgctcctgacacatgggttccgtctggttggaatggaaacacttgcacttatttaggttttaaacaactcaatgggcaacgccgtgataatcttgaattccgtgttagtagtactcatgagagtaaagggcttggtggtacatcgtgggaaataaatggagtaaatccagaccctttaaaagatgtaacacgtccggatgcattagatttgagacaagcggatatttccagtcaacagaataagttagttgagttttataatacttatttgacgcgtaaaatgaagaaaggtgatgcatatactactgatcatacacctaaatatatgaattttcttcctagatattacttcctaggttttgcggaaggagctcaaaaggctaatcagacattgccacagactattggttgggcagattataataatggtggtgctaacggtactttcgatccattagcagaataaatttataatatctgatttatcttgataacgtctctaatatctcttgaatgagaggattggagacgttatttttttgataggaatatgggttatgagggaaaaacatatttaggataataaattctgttctactgattacaaatcttttcttctttcgtcttattattgtatttttgaattaacaacttcacaaaaccaaataaaaatgaagaagaaacaggtacttttagcagtttttgctgcaacaatgttgactccgaccgttgcatgggcgcaatacccacaaataaccggcgaagccaaagaaaattatacaaagatgatgactgaagagcggaagcgctctgatgaagcatgggcgaaggcacttccaatagtgcagaaagaagcgaaggaaggacgtccatatattccttgggctggtcgtccgtacgatttgccgcaggctgatatcccttcattcccaggtgccgaaggtggtggtatgtatagtttcggtggccgtggcggcaaagtgataactgttacaaatctgaatgatcgtggaccgggctctttccgtgaggcatgtgaaactggcggtgcacgtattattgtgttcaatgttgccggtatcatccgtctggaatctccgattatcgtccgtgctccctatgtaaccattgcagggcaaacagctccgggagacggtgtttgtattgccggcgagtcattttgggtagacacacatgatgttgttgtacgtcatatgcgtttccgtcgtggagaaacgaaagtatggcatcgcgatgactctttcggaggtaatcctgttggtaatataatgatcgaccactgttcctgtacatggggattggatgaaaacatttctttctatcgccacatgtacgacccgagtgaaggacaatatgaaagcaaagacttgaaacttcctactgtaaacgtaactattcaaaatactatctcggcaaaagcgttggatacatacaatcatgcgtttggtagcacgttaggtggtgagaattgtgcatttgcccgtaacctttgggctagtaactccggacgtaatccttctatcggttggaatggcatattcaatttcgttaataatgtagtattcaattgggtgcaccgttcttctgatggtggtgattataccgctatgttcaatatgattaacaactactacaaaccgggacctgctactcctaaggattccaatgtaggacatcgtatcttgaaaccggaagcaggacgtagtaagctggatcataaagaatatgggcgagtatatgccgacggaaatataatggaaggctatcctgaaataactaaagacaactggaatggcggtattcagattgaaactcaaccgaacactgacggatatactgaatacatgcgtagctataagccgttcgagatgccgtatatcaatatcatgggggctaaagatgcttatgactatgtattgaaacatgtaggtgcgaatattccttgtcgtgatattgttgacgaacgtgtgattgaagaagtaagaacaggtattccttattatgaaaagaaacttcctaaagacgcttatggtgacttgacaggtttgtctcctaagtcaatgggggaagacggacagttcaagtatcgtcgtttgccgaaagattcttataagcagggtattattactgatgttcgccagatgggtggttatcctgaatacaaaggtactccttatgttgatacagacaaagatggtatgccggacgaatgggaaattgctaacggattaaatccgaacgatccgagtgatgccaataaagactgtactggtgacggatatacgaatattgaaaaatatatcaacggtatcagcacaaagcataaagtagattggagagatatgaagaacaactacgatacattggctgaaaaaggaaaattaatgtaattatgaaaaagatactgatactatcattgctttttatttccggttggatgtctgcgcaggcagtcgacttaaataaagagaatcgtgatcctgaatatgtaaagtctattgtcggccgatcacaaaagatcgttgataaactcggacttacagatgcgaaaatagccgaagatgttcgcaatgtcatagccaatcgttacttcgaattaaatgatatttatgaggtacgggatgcgaaagtcaagaaagtaaaagaatccgggttgactggtgaggctaaaaatgaagctttgaaagctgcggaaaatgaaaaagatgcggcactatatcgttcacatttcgcttttcctgccaatttatctctctttcttgatgaaaagcaaatagaagctgttaaagatggcatgacttatggagtagtaaaagtgacttatgactcacatctggacatgattcctactttgaaagaagaagaaaaagctcaaatttatgcttggttgatagaggcccgtgaatttgcgttggatgcagaaaattcgaataagaaacacgctgctttcggaaaatacaaaggacgtatcaacaactatctggctaaacgtggatatgacctgaagaaagaacgagaggaatggtataaacgtataaaagcccgtggaggttctatataattaaaaaataagatactataaaaagaagtgaaattctttcccattgtaaatggttagtttgtttgatggtggaaagggtggctcggagagtcgcccttttatcgtatataaattttgaatctattgattcttctagtatatttgagtacaaacggcgctttccatcgtctcctctgtataaaagatacaaatatagaatatagaaatgaaaaagttaagaaatacattagccgcaataagtcttttgtttctggcttcttgtggggggaacaaagactactacatgttcacttcgtttcatgaaccggctgatgaggggttgagatacttatatagtgaggacggaattcactgggacagtattccgggagtttggctaaagccggaactgggacagcaccagctcatgcgggatccctcgatggtacgtactccggatggaacctaccatttggtctggactacaagttggaaaggtgatttaggatttggctacgcacattccaaagatctgatccattggtcggaacaacagatgattcctgtaatggcagacgaaccgactactattaatgtatgggctccggaaattttctatgacgacgagaacgatcagtttatggtcgtatgggcttcctgtgttcccgggcgtttcgaaaaggggatagaagaagagaataataatcatcgtttatactatatcactacaaaagattttaaaaccgtctcgaaagcaaaacttttgtatgatccgggattcagtaccattgatgccgttatcgtgaaacgggcaaagaatgactatgtaatggtactcaaggataacacccgaccggaacgtaatctgaaaatcgctttttccgattctatgaccggtccttattcgcccgcatcccaacctttcactgaatcctttgtagaaggaccgtctgtagagaaagtgggagacgattatctaatctattttgatgtatataagaaaaaaatatatggcgctatgcgtacgaaggatttccggaactttacagatgtaacagaagaggtaagcatccctgtagggcataagcatggaaccatatttacggctccggaatcagtcgtaaaaacattgctggaagaaaagaaataaacccagaaacaattttaaatcagaataaatcatgaacaactctgctaaaattctttttgtactggctgccggttggttgactactacagcctttgcacaagatagaattcattatacaggaaaagaattatcgaaccctgcttgtcacgacggacaactgtctccggtagtcggagtacataacattcagttggtacgtgccaatcgtgaacatcccgatgcttcgaacggcaatggatggacgtataatcatcagccgatgctggcttattggaatggacagtttttctatcaatacctggcagatccttctgacgaacacgtaccgccttcacagacttttctgatgacatcgaaggatggatatcgctggacaaatccggaaattgtgtttcctccttatcaagttcccgatggatacaccaaagagtctcgtccgggtgtgcaggccaaagatctgattgccattatgcaccagcgtgtcggattctatgtttctaaatccggcaagctgattacaatgggaaattatggagttgctttggataaaaaagatgatcccaatgatggaaacggtattggccgggtggttcgtgaaataaagaaagacggttcttacggaccgatctatttcatttattataatcatggatttaatgaaaagaatactgattatccgtattttaagaaaagcaaggatcgtgagtttgtgaaggcttgccaggaaattcttgacaatccgctgtatatgatgcagtgggtggaagaagccgaccgtgaagatcctattctcccgctgaagaaaggatacaaagcattcaattgttatacattgccggatggacgtattgccagtctttggaaacatgcgcttacctctatcagtgaggatggcggacatacttgggcagagcctgtgcttcgtgcaaaaggtttcgttaatagcaacgcgaaaatttggggacagcgtttaagtgatggtacatacgctactgtatataatccgtcggaatttcgttggccgctggctatatctttgagtaaagatggattggaatatacaacattgaatctggtgcatggtgaaatcactcccatgcgttatggaggaaattataaatcatacggtcctcaatatccacgtggtattcaggaaggcaatggggtacctgccgatggtgatttgtgggtttcttacagtgtgaacaaggaagatatgtggatttcccgtattcctgtcccggtggaaataaatgcttcagcacatgcggatgatgatttctctaaaaataaatcaattgcggaactgactgactggaatatttattctccggtttgggctcctgtttctttggaggatcaatggttgaagttgcaggataaagatccgtttgattatgccaaagtggaacgtaaaattccggcttctaaagaattgaaagtatcatttgatttgaaagccggccagaataataaaggcacactccagattgaatttctggatgagaatggaatagcctgttcccgtatagaacttactgatgatggcatttttcgattgaaaggcggctcccggtttgcaaatatgatgaaatatgaagcaggaaaggtttatcatgtagaagcagtcctttctactgttgatcgtaatattcaagtatatgtagatggcaagagagtagggttgcgtatgttctatgcgcccgtggctgctgtggagcgaatcgtattccgtactggcgtacctcgtacatttccgactgtagatactcctgccgatcagacgtatgatctgccgaatgcaggtgcacaagatccattggctgaatatggcattgccaatgtgaaaacatcttctacagataaggatgcgtcttctgcttttttaaagtatgctgacttcagtcattatgcagactatttcaacggtatggaagacgaaaatattgttcaggcaattcccaatgcaaaggcttcggaatggatggaggaaaatattcctttgttcgagtgtccgcaacataactttgaagaaatgtattattatcgttggtggtcaatccgtaagcatatcaaggagactcctgtaggctatggcatgaccgagtttctcgttcagcgttcttattcagataaatataatttgattgcttgtgcaattggacatcacatttatgaaagccgttggttgcgtgatccgaaatatttggatcagattattcatacatggtatcgtggcaatgatggcggtccgatgaagaaaatggataagttcagctcatggaatgcagatgctgttttggctcgttacatggtagatggtgataaggactatatgctggatatgaagaaagatctggaaaccgaataccagcgttgggaacgtacgaaccgtttgaagaacggattgtattggcagggtgacgtacaggatggtatggaagaatcaatcagtggtggacggaggaagaaatatgcccggccgacaatcaatagctatatgtatggcaatgctaaagcactttcatgtataggaattctttccggtgatgaggggatggctatgaaatatggcatgagagcagatactctgaaaaatctggtagaaaatgaattgtggaataaacgtcatcagttttttgaaacgatgcgtatggactcttctgcgaatgtgcgtgaagcaatcggatatattccctggtatttcaacctgccggataccacccaaaagtatgaaattgcctggaaggaaataatggatgcaaaaggcttttctgctccttatggactgacaactgcagaacgtcgtcatccggaattccgtacacgtggagtaggcaagtgtgagtgggacggtgctatctggccgtttgcttccgcacagacattgacagcaatggctaactttatgaataattatccgcagactgtattgtctgacagtgtatatttccgtcagatggaattgtatgtggaatcacagtaccatcgtggtcgtccctatattggtgaatatttagatgaggtgaccggttattggctgaaaggagatcaggaacgtagccgttattataaccattccactttcaacgacttgataattacaggactgatcggacttcgtccacgtttggataatacgattgaagtgaaccccttaattcctgccgacaaatgggattggttctgtttggataatgtattatatcacggtcataatctgacgattctttgggataagaatggtgatcgttatcattgcggaaaaggattacgcatttttgtagatggtaaggaagtaggacatacagatacattgactagaattgtttgtgaaaatgtactcaaataatctttatttttagacataagaacaaaagaacataaatgctgcgctttgaaattatttctattgcttattgaactgctattttattttttgttcttatgttcttctgtctgaattagattcccatttatcgaacaaataaaagatacttgaaaaatgaaattcaaaaagattcttctttcattgctaacttgtttgtcttgttttgtacaggcgaagaatataaccatcagtcgtcttacctgtgagatgcaggagggactggtagtggtcgaaggttcaccccgtttgggctgggtgatggaatcgccggaaaatgggacacgacaatctgcctatgagattgacattcgggaggcttttacagggcgttccgtttggaatagtgggaaggtttattcttcgcagagtcagttagtttctacaaagggggcagatatacgtcctgataactcatttaattatagttggcgcgttcgtgtttgggatgaaacagatacaccttccgagtggagcagtgaagcgaaattccgggcagtacccgaaaggttatcttcggggcagtggattggagctattacccgacaaaatgctcatttaccggaagggcgtaagttccacggtggagagttgaagaaaccggaagtgaaagcagcttgggaagcagtagacactttggcaaagaaaagtatttgtttgagaagaacattccaggtaggagatgcgacagaaggggcggcaaaccgaaaaccgggtaagaaaatagtggaagcaacggcatacgtttgtggtctgggattctatgagttttctttgaatggcaaaaaggtaggtaacagtgagtttgctccattgtggagtgattatgataaaactgtttactataacacatacgatgtgacggaacaattgcggcgtggtgaaaatgtcgtaggaatcttattggggaatggattctataatgtgcagggggggcgttatcgcaaattacagatcagttttggtcctcccacacttttatttgagctggttattaactacgaagatggaacatgtacgacagttcattcagataatgactggaaatatgattttagtccggtaaccttcaattgcatatatggaggggaagattatgatgcgcgtcgtgaacagaaaggatggaatcagattggctttgatgacagtcactggcgtccggtagtcgtacaggaagctcctaaaggaatacttcgtccacagatggcggctccggtgaaaatcatggaacgttatgatattcaaaaggtaactaaactaaatgcggaacaaatagcatcggcttccatatcgaccaaaagaacagtcgatccttctgcttttgtattggatatgggacagaatctggctggctttccggaaataacagtacgtggtaaacgtggacagaaagtgactttgattgtagccgaagcattaacggatgaaggtgcttgcaatcagcgtcagacagggcgtcagcactattacgaatacactctgaaaggggaaggtgatgaaacctggcaccctcgtttctcttattacggttttagatatatccaggtagagggtgctgtcttaaaaggacagaagaatccgcagaagttacctgtattaaagaatattcaatcctgtttcgtatataattcagccaagaaagtttccactttcgaatcatccaaccggatatttaatgctgcccatcgattgatcgagaaagcggttcgcagcaatatgcagtctgtgtttacggattgtccgcatcgtgagaaacttgggtggctggaacaggtacatctgaatggtccgggtttgttgtataactatgatttgacagcatacgctccgcagattatgcagaatatggtagatgcacaacattccaacggagccatgccgacaactgctccggaatacgtgatttttgaaggtccgggtatggatgcttttgccgaatctccggagtggggtggttctttggttattttcccttttatgtactatgagacttatggagacgattcattgattaagaaatattatccgaatatgcgtcgttacgtggattatctcaagactcgtgcagataaaggtattctgtctttcggattgggagactggtatgattacggagattttcgtgcgggattctcacggaatacacccgttcctttggtggctactgcgcattattacatgacagtcatgtatttggtacaagccgcgaaaatggtgggtaatgactttgacactcgttattatacttcgttggcacaggatataatggctgcatttaataaatattttcttcataaagatactgcacaatatggtacaggaagccaatgcagtaatgcgcttccgttgttcctccaaatgacgcaggatgcagatgaacaaggtaactaccgaccggatgcagatttgcatgagaaagtattcacgaatctgataaaagatgtggaagcacatggcaaccgtttgactaccggtgatgtgggcaaccgttatctgattcagacattggcgcgtaatggagaacatgaacttatttataaaatgttcaatcatgaagaagctcccggatatggtttcctgttaaaattcggcgctacaactttgaccgagcagtgggacccccgtcaaggttcttcctggaatcactttatgatgggacagattgatgaatggttctttaattcactggtcggtattcgtccttctaccactccaaaacaaggttatcagaagttcatcatcgctccccaacctgtgggagatttgaaatatgtcaaagcgtcgtatgatactttatacggtaccattaatgtggactggacttgtgagaatgggactttcactttaaacgtgtctgttccggtgaatactaccgctgtcgtttacctcccaggcgaaaaagaaccgaaagagatacagagcggaacatatcaattggtttgtgcaaaatgaaagagacattttatatatatttgtagaatgaaaaacaatgtattcgtataaaaaatcatgcagcatctttattttaatcatgtagcatgtttgaaaaaaacatctcaatgattgtcttcaaacattgggaagaaaaaaagattctattagcatgattttttagaaggtaacaatgaaattatactttaataatatcgattatgaatttacgaacaactcttatcgtctttctttgcttctgtgcaaccacagttcttcgtgccgagcgtgtagatatgctgaaggccggtgcaaaagcaaatggcaagactcttaatacaaaactaatcaattcaacgattgaccgtctgaaccgtgggggcggaggtactcttttctttcctgccgggacttatctgacggggagtatccatctgaaaagtaatattacactggagttggaagccggagctaccttgctcttttctgacaactttgatgactatcttccttttgtcgaggttcgccacgaaggagtgatgatgaaaagtttccagcctttgatttatgcggtagatgccgagaatattacgatcaaaggagaaggaactttagacggacaaggaaagaaatggtggatggagttctttcgtgtcatgattgatttgaaagacaatggcatgcgtgatgtgaataaatatcagcccctatgggatgcggcaaacgatacgacagcgatttatgctgaaacgaacaaggattatgtaaatacattgcaacgtcgctttttccgtcctccgttcattcagcccgttcgttgtaagaaagtaaagattgaaggagtgaaaatcataaattctcccttctggacggtcaatccggagttttgtgacaatgtaaccataaaggggatcaccatagataatgcaccctcaccaaatacggacggagtgaatccggaatcctgccgcaacgtacatatcagcgactgccatatatcagtaggagacgattgcatcacaatcaagtcgggaagagatgcgcaggcccgtcgtttgggagtaccttgcgagaatatcactatcaccaactgcaccatgctttccggtcatggaggcgttgttatcggcagcgagatgagtgggagtgtgcgtaaagttactatttccaattgcgtgtttgacggaacagatcgtggaatccgtattaagtcgacccgtggaaggggaggagtcgttgaagatattcgtgtcagcaacgtcgtaatgagcaacattaaacaggaagctgttgtattgaatttgaaatacagtaaaatgcctgccgaacctaagagtgaacgcactccgatattccgtaacgtacatatcagtggaatgactgtgacaaacgtaaagactccgatcaaaatagtgggcttggaagaagcgccgatatctgacatcgttttgcgtgatattcatattcagggagggaaacagaaatgtatcttcgaaaattgtgaacgtatcacgatggatgacgtaatcgtcaatggtgaaaaaacaactagcataaattaaaaataaatgaaacgaatcctttttactatgcttcttgccgcatctctttcggccgaagcccagacgcaaacatacgagacagaatttgcccgtcccttgaatgaagtactgacggatatacagaaccgtttcggagtccgtttgaaatatgacattgatacggtgggaaaagtgctgccttatgccgatttccgtattcgtccttattccgtggaagagtccttgacgaatgtattggcacctttcgattataaatttgtcaagcagaaaggaaatatgtataagctgaaagcatacgagtatccacgtcgtacagatgcagatggagagaagatgttggcttatctgaatacactctatacagaccgacagtcttttcaacttcgtgccgattctctgaaaaaagaggtacgtcagcgtttaggtatcgatactttgctggctcaatgtgtcaaatccaaacctattctttcaaagatacgtaagtttgatggctataccgtgcagaatttcgcgcttgaaacacttcccggattatacatttgcggttctatctatacgccccaatcgaaagggaaacatgcgttgataatctgccctaacggacattttggtggcggacgttatcgggaagaccaacaacaacgtatgggaactttggcacgtatgggagctgtttgtgtagactatgatttgtttggatggggagagtcggctttgcaagttggcagtgcggcacaccgtagcagtgcggcgcacactatacaggcaatgaacggcttactgattcttgactacatgcttgcttcccgtaaggacattgataccagccgtattggtacgaatggcggttcgggtggaggtacccatactgtattattgagcgtattggatgatcgtttcaccgcttcagctccggtagtgagcctggcttctcacttcgacggtggctgtccctgcgaaagcggaatgtccattcaactatctgcaggaggaacctgcaatgcggaattagccgctacttttgctcctcgtccacaactgatcgtatcggatggcggcgactggacggccagtgttcctactcttgaatttccttatctgcaacgaatctacggattctaccaagcaaaagataaagtaacgaatgtacatcttcccaaagagaaacatgactttggtccgaataagcggaatgctgtttatgacttcttcgcagaagtattcaaattggataaaaagatgttggatgaaagcaaggtcaccactgaaccggaatccgctatgtatagttttggtgaaaaaggagctttgcttcctgaaggcgccatccgttcttttgacaaggtagctgcttattttgacaagaaggcttatgctaacttaaaatcagatgcttctctcgaaaagaaagccatcgactgggtagcttctttagagttgaacgatgataaaaaggcaggttttgcagtaactgccatttataatcatcttcgtaaagtacgtgactggcacaatgagcacccttatacgacaatccccgggggtatcaatcctctgacaggcaaaccgctttccaagctcgaccgtgaaatgattgcagattccgctatgccgaaagaagtgcatgaaaggctaatgaaagatttacgcagagtattgacggaagaacagattgaacaaatcctggataaatacacggtaggtaaggttgcttttaccttaaaaggttatcaggccattgtacccaatatgacggaggaggaaacggctttcgttctggaacagttgaaactggctcgcgaacaggctattgactacaagaatatgaagcagatttctgctatcttcgaaatttataaaaccaaatgtgagcagtatttcaatgagcatggtcgcaactggcgtcagatgttcaaagattatgtgaataagcgaaacgcagaaaagaaggctcaaggaaagaaataaaatgaaggtaaacccttaaccttctacatagccggaatatctccggggtaatagaagaatataatagagctatgctttgcaactgacaaagcatagctttatcatatctaaagctatgctttagttcccctaaaacactgctatcacttatttcttcacgattactaaacatctttttcgcagaaaatgtgttattttgtagatggctaacagaaatgtatatgatatggataagcaaaaagtagcattagtcctttccatggggggagcacgtggaatagcacatataggagtaattgaagaattactttgtcacaactttgagattacttccattgcaggaagttccatgggagcaatggtgggagcaatgtatgcttcaggaaaaatggaagaatgtaaagaatggctgtatagttgggacaaacgcaaaatgtgggaattggcggatcttaccttaagccgggatggattagtgaaaggtgaccgttttattaaagaactgaaacaaattattccggacatgaatatcgaagacctgcctgtcccttatgtagcgatggctacggatattgtccgcgatcaggaagtcaggtttgacagagggagcttacatgaagctattcgtgcgtctatttctatccctatgcttttccgtccgttgagaaaagacggtatggtattgattgatggaggtattctgaatcctcttccattgagtcatgtgcaacgcactgaaggagacattctgatagctgtcgatgtgaatgcacccattgatactggaaagaaaaagaaagtatctccttataatctgttgacagaatcttccaggatgatgatgcagcaaatcacccgttatcagatagaacgttgtcagccggatatcttaattcagatttctggcgatacgtatgatatgttggagttccatcatgcagcttcgattgtaaagacaggagtggaagttactcgaagaatattaatgcaataaatagtggatactatcgtatttgttatcgtgcccaaaagactttaacaaatacgatagtattcattaaagtgatagatttttattcaatataaatcatctttttcgtcattcccccatcaatcgtgatgttttctccattgatgaaatcattgttttcctcgcagagaaacagacacatacgggcaatatcttccggtttgcctacccgtcgcgaaggatgttgtgaatgatcttccggccggagttggtcataatcatgagtttgtatccatcccggagcaatagagttgacggtgatattccattcagataacgataaagccagtgcatgagttaaagaatagataccgcctttcgaagctgcgtaaccttcacttcccgattcactcatcaggtaacgtgtggagcagatattgataatccggccgtatgggttaggagaggactgctctttacgatgtatggcaagcaggcgggaggtgataaatacagggcgtaggttgatagaaagaattttgtcgaaatcctctacgctcgtttcggtgatagacgaaaattgactaataccgacgttgttgataataatatcaatatcattccattcggaaagaatacgttgcatgcaactttcaagcgcatccttatcgctgacatcgactttatggaatatagatccggttgcttttgcagtctcttgtcccgctatttcatttatatcacaaaaagcgacttgatcgccggacaggcaaaaagcttctactattgccttgcctataccttccgctcctcctgttataaatactcttcttttggagggggatgattttgaggtcattggagtacacgaagccgattctgccggatgaactgttgtagatttcttcttaccatatttctgtgcttgtttccaagcagcctttctggcctcatattgttcctgttgtctttctatataattatctgccatcgttcttttttatttattggcaaatgtaaaatataaaatggataaatacaaagaatcgaccgctcttttgcggacaaaggagcggtcgattttatttagaagacgattcaatttaaaacttcgtcggatctatctctgcatatttaattcgttgacggcgccaagtgtaaatggcatgcagtttcccgtctttcccttgaataatgctagggtaagagtattggctaatcggactatcttctaatgtaagaacaggctgccaattgataccatcttctgaaacggccacacagagcggagtacgcggacctttcggagttccgggcaatgtagagaaattattgtagataagtatatgtctaccgtctttcattgtcacagcatccgttccggaattattattcggaacatccagtagcgttactttactccacgtatcaccattatcgctgctccacgcagttgctacctgtgcgttacgtgtgcggcagagtatctgtaatcttccatccttatgcttcaaaatactgggttgtattgcataaacaggtttggctccttctcctttgatagcttctccgccttcctggtcatccacattcatatccccctttttgcggttttgggtggggacggataactcggcatccagtggtccgaccatcttccaggtcttgcctttatcatcggaaatctcgaaatgaactctccatccgttacttccttccgtactggaagggcagatgatacgcccattgatatattccggcttattcttaataggtccaagaaaaccttctggaagcggttcgcgtttgctccaggtctttcctccatcgcgtgaacgaactaaccatcctgtccagtcactcactttcagacctattttatagaataaaatcaagtcacctccgggaatctggaaaagaaccggattccaacaagcttttctgcgggcaataagttttcctttttcatttttcacaggtgtacaagttgaatcgattccagccaatgcagcttgtgaatctttgagcgagaacacaccgtcagcggcaagttggggggcggtccattcttttgagtctttaggcttacgacatacccaaatgcaacaatccggattgcgctctttggttcctccgaagaaagaggctacgagatcgccgttcttcagttctacaatcgtagctccgtgacattcggggaaagaagcttttttgtataggaattcatcacttagaatagctgtattccgggtgggtatgtctacactgaagtgatattttcccgatccgatcttttccttccgtccatccggtaggtgcacttcacctgttgtgttggcaggaagctcgatgtcccattccagatgagtaggagtctttgtccaccggctgattattttcccgtagatactcatgtatgaggcatccacattgctcaattcctggatttcaaaagccggttggaaaacgatatgtttgtaaccggacttccagcggtctgcacgaatacctgccaaattattgaaacaccagggtaataaatcgcctaaaagcatcacgtgattaccgctgttcatttcaggattggccgtatcaccgttccataactcccaaatagtggtagcacctttttcaaccatatatccccaagatggatatgttttattggtagccaacaggtaggctacatcggcatggccacgacggctcaattcgcgcaatagccattgcacaccgattactccggtacttatatgtcccttgttggtggtgataatagaagtgacggcatttttagctacctcatggatgtagttcttaggtaccagtccaaaagcaagtggcaggatattggcagtaactgtgttgttgccatagaaaatgctgtcgggatataaagtatgtcccggtacgggagaagtaccttcttttatgtgcagaaaacgggcattgaatgcatctttcatacgatgttccaaatcttcccattcttctgcgtcagctttcagcccttgcaggcttgcaaagcggtgcatcagttgtaataccttcagataataagcggtggcgatcaaggcaccgtcggtcttgcgggaggggtccttactatgaattaactccagtgattcgggtggaacacaccagtcaccatatttatctttggtgatgataaaatcctctgtcatgtagtattcacggatatgagatacccacttcttgatagccggataattctcttcgatcgaacgtttatctccaaagttcgtgaaaagcatatcgcaggccatcggtaaggcggcaggccaagtcacattgtccgagtagtagttccagtatgccggggctacatcaggaatacaaccgtcttcccgttgcgcttcgcgaatgtcacgcgcccatttggtatacatggcgtaattatcgaaaagcatactttctccccaacaacccatggtacggtcacccaaccagggttggcgttcattccgttgcggacagtcaaccggcatccctttatagttgctccggattccccaaaatgcattacggacaatcttattcagagtttcatcggaacagttgaaagtaccggtatgttccatttcatcttctactacttcggcaacgaaatcttctgctttggcgtccggataaccgctgacttctacataacggaatccatgataaataaagcgaggcgcccaggtagcatcttttgtttcgcgtccgttggcaacatatacatctgtagaacgggcatccctgaagtttcttgtataaagttcaccattatcttgcaggctttctgcaaaacggagacggatgctgtcaccggcttgcccttttatccggaaacgtacccatcccgccatattctgaccgatatccagaatatatttgctaccgagctttttaatagaaacgggtttcaaggtttctgtgactttcatgcccggcatcatttgtgcacgcaatgttcccgaaggaatactgacgcgttgggcctgcatccagcccttgtcatcatatccggtttgagtccagtctcctaactctttacgggcatcgtattcttcgccgtcatattcattgttgctacggataggaccttcagtagttaatttccatgaagtgtttgtagcaattgtttctttgctgccgtctgcatattcaacaatcagattcaaccgaagcttaggataaccgaaagtcggtatcttatacggtttatagttctgacgcatcgtatagaagcggccatttccgagagttactcccatagcattttctgcctgaagcagtgaagtcacatcgtatgtgttgtacagaatcgttttccggtagtcggtaggagcaggtgccagtacttgattgccgatgcgttgcccgttgataaacagctcatataatcccattccggcgatatgtactgtggcacgtttcacgcctttctttaacgcaaactcttttcgaagataacgggctgccaaacggctccattgtgtttcgctgtctccgggagcggcccgatccaagccgatccattgtccttgccagtccgcttcattaaatagtcctgtggtccaaaaagccggagcactccaattcgttgcacctttgttggtgtcgattttcactttccaatagtaggaagcattacgttttaatgtttttccctgataagtgatccattgggaagcgtcagattcaatctttcctgaatcccatatatctccttttccttgttccaatagctccggggaagatgcgacaagaatgtgatacgcagtctgtatcacattctgttcatccgattcgatgcgccaactcaatcggggctggcgcacgtcgataccttccggacttttcagcagttccgttcgcagatcagtgatatctatggctgcgtatatggccccggtaaagagcagaagaaagaagaatgatactatccttttattcataagtatgttttcatcattcgtttatataagattatttattccatttttgttgtgcgtccggtaactctgtccagtctttccctatatagttcttactactgtccactacaatcaggatatggtcgttcccgctgcaataaccgctatcgtgctggaatttatgcacaccattatcaaattctccgatgtattccaatttaccatctttcgtagtgtaccaccaggcattctttttcgcaccgctaatcttgctgaaatcaacttccatcggacgtccggtatagttgtataccatcagataatcattaccacgtgtagcgatagcgcggtcgtaacgttctccattctgtcctgcaatgatagactgatcgggtatgcgttcgaagaacgggaaagtcagcatcaggtttttcagatacttcatctgattgtagcccggatcattcaaagcatcataccagggcttttttgcaccgtaagcaccacctacacccggtttgataaattgcatgattgagttatggccgtaagtatgtccgaaagctccggcaaatacagaccagtaagcataacggcgtacgtcataatccttccacaacagttcattctcatcgtgcaggccatgaggaatttcttcatagatcggttcgccgtcaatcacaggtttcatgggttccatggccatgctgcgttctacaaaacgccagttatcttcttccgtattttcttcgataggatagtcaccatctccgaaacgttgtccgtagcggcggtgtccgctttggaacatgttgaaatccaaccagggagcattattgaaccaagttgcggaggttgtccttccgcgtggatggaatgtcatcaggtgatttttgtcgatagccttgatagaggttgctaatgcttcccattcggctgttttcacgtctccgcgaatatccccaccgataaaccagataatattgggttcgtccttataacgctccgctaaaaacttgccgtatgcttttgcctgttctacagtcatttcgccccgatttaccgggcttccccaaatacagaccatgccgatatattgtcccttctttgctgctgtacggatgatgtaatccatgtgatcccaataaccgtatacgcctttttgattgatgtttttgaagttgtatccgtcaatcatcgaatattgtccgtagatattcatagacggaacattgttcaacgtttgaacctgaatcacgttatatccgcgacgtttacattgttccaggtaatattcggcttcatcccggttcaagcgttcgggcaatagccaaccggtttctcccaaccaaaagaaaggagtgccgttttcgtgtttcagataacgtccctcttcggaaactacgagcttgccattgttccaggggatatacgtcttttgtgttttcttctgtgctgcgaccgaagttgccattgtcaatagcagcaacaaaagaggaagaattttgaattttctcattgtactttatcgtttttagtttatttctttgtcattttctcatactcaatggcagccagaataaatgaacctaccgatttcggatcattttctatgatcggttcactgatataatattcaaatgagccgtcacggtatctttttgaatctccacccaatcctgcaacagcacagcaattggtgattgtataactgccatcttcttccaaacgggtaaatgtctttaccattccgtcaaaggctttttgtgtcggttcgatatattcgttgccaatatatcctttattaatagctttggcaagcgtatagataaacagggcagtggcagatgattccaaataattaccttcacgcgctccctgatcggttacctgataccaggttccggatgaaggatcctgatatttcacaatcgctttagccaatccctgcagaatctgtataatgctgtcgcgtccggcagtttcctgtggcaggaagtccagtacatccacaatagctgctccataccatccgatgctgcgactccaaaaattaggagagcaacccgtttcaggattggaccatttctgttcgtgactttcatcccatccgtgataataaagccctgttgcgggatcataagtcttgctctttatcaaaagaatttgtttcgttgcttcgtcaaataaagcaggttcatcaaaagtagcaccatattgaaccagataaggagaagccataaaaattccgtccaaccacatttgatgaggatatctcaatttatgccaaaatcctccctcactggtacggggttgctccgccatttgcttgcgtaaagtatccatagctattttgtagcgttcgtctccggtctgtgcataaagatcgaaaaggatctttccgccgttgacattatcaatattgaatgaaagatacttcatggttttgatatgcccgtcagcatctatcaggctatccgcataaatcttggcatactcataatatgtactgtccccggtatgtttccattcttccaacatggatttcactactaatccgtgggtatatccccaacgtggttttttagctttttcaatcatccagggttcggggaaacgtttcatttcggagcgtgccatgcgttcactccatttttcagtctctgctttctgaggtgccgtacatgcgataaaacaagtagctccgcaagcaacaatcagttttaataagtttctgttcatatcggttgagttattattttccggtcaatatatattcctgtcctgctttggtgggcaggtcatataaataggtatctgcaacaaccactttattcaggttggctttttcgttgattaatggttcgggaatggcaggaacagcgtagagaggatttgtgtttgcccctttggcacgtttcagccctttgcctgtcaacgggttaagcgagcgcaggcggcagttgccacctttatgggattttatgaccaggcggctgactttcccgtttttccaactcaaatcaagttcgaaacctccacgggcaatgattcctttgatagaaccttctttccaaacggcaggcaatgcaggaagtaaatatataaaactgtcgtaactttgcatcaacatctctgcaatacctgcggcacaaccaaagttcccatcaatttgaaatggcggatgcgcatcgaacagattagggtaggtgcctccttttttcttttcgttgcgtacgagagtcaactggtcagttatcagtttgtaagcgtggtcgccatcaagcaggcgtgcccaaaggcaaactttccatcccatgctccacccggtcgacgggtcgccacgatgaatcagagaagtacgtgccgcatcgaatagttcgggggtacggtaaggggaaatctgattgctggggaaaagtccgtacaaatgagaaatatggcggtgcacatccttcggatcatcccagtcgaacatccactcctgtaattgtccccaatgtcctacctgcatgggagccatttctttgagacgttgtgtcagatgagaggcaaactcccggtctgtatccagtatttgagaggcagatataattgctgtccaaagatcgaacaccaattggttgtccatggtgcatccggcagctgtagtggcttttccattacttcccgaatgtacattctccggtgaattactggggcagactaccaaccagttgtgtacgggttctttcaccattatttcatcaaagaaacgtccggactctttcagtatcggatagacggaacgcagaaattccacatccccggtgtataggtaacgctcccaaagatgtcggcaaagccatgcgccaccactgggccacatacccgaaggagctttgtctactgctcctgtaatacgccatatatccgtgttatgatgcaacacccatccgttggctccatacataatcttggccgtctcttttcctgtgtcactcacttcttttatcagacggaataacggttcattcagttcacttagattcgttacttccgaaggccagtaattcatttccaaattgatattacaagtatatttactatcccaggaaggaactaatttatcattccaaattccttgtaaattggcgggttgtcctcccggttgggaagaacagatcaacagataacgtccgaattgaaaataagtagcaaccagatgtgtgtcattggtgtttttgaaattctccacacgcttatcggttgtcacatttgcatattggtcttctcctaaatcaagagaaacacgtgtcagatattgtcggtagaaatcaacgtgattccgcttcgattcaatgaacggatgaaccattgcctttgccaaatagttttttgcccgttctatctgattaccggtgatgtcttgatagttattgaaattagttgcaatagatacatagatgatcgcttcgtcggctttctctacagaaagtattccatcggcgcaagctatttctccacctttatttttagcagtcaatctgccttgaaattctacttttcctttcaatccttcatgcaaggaagagactcccgagagtgttacacagtttccctcttcagaagcgatcataacatcctggtgaggggaggtaagctgtgcattgaaagtaatttggccggggcgattggcagtcagtcgtaccattactacctgatcggtaaatgaagtaatcgtttcgcgttgatactgcacaccgtctacttcataacgtacgattgcacgtgcggaatccagacttaattcccggtaatagttagaataacgtgtatgtccgggaaaagcgattcgtaaatctccgaaactttgatatggcattcctgaatttgtctttgccatcaccttttctgtagcgagagtttgtgcttccagatattttccggcaaaaacaagttcacgcactttgggaatatactccagtgcattcggattagcgttattattgggacgtcccgcccaaatggtttcttcgtttagttgtatttgttctgtgcctggtgttccatataccatggcccccaaacgaccatttccaaggggtaatgcctcggtccatacctgcgcgggacagtcataccatagcttgtattcgggtacagataactttttctcctgtgcatgaatacaacctacagatactattaccaacagatatccgattaatctctttttattcatttctttctattgcttttattcttatataaacctgttgtttacatacttttataaaagagacgattgaaagttctttttgtacccattgcacaagcaataagaaataggaataattaaaagttatcgggtataaaaaaaacgaacttcaatatccggctaaaaagaacttactttgcatctgtaaaaatactcctgaaaagtataatttcagatatagacttatgtatttactattaaacaggtatatgaatatgtataatttaatcattaggccgttattattttgcattgatccggaaaaagtgcaccggatgcttttaagctggttgaagttttatcgctatttgtttccggtccgagcttgcgtgagaggctacagcagagtttctgatccattttcgtatgggcatttgcaatttaagaaccgaattggactgtctgccgggtttgataagaatgcagaggcttttgatgagttggcagactttggtttcggctttctggaagtaggtacagtaactcctgacagccaatcaggaaatccttccccacgtatttttagattggtggatgatgaatcgttgatttcacgtacgggcttcaataattgtggagtagatgctgtccggcaacatatcaggaaatatagaaagcattcttatgtattaggagtaaatattaataagaatccgctttctacaggagatcaaattgtcaaagattttgagtcgactttcatccatttatatgattgtgtggattattttaccctaaactggggtagtatagataacgacctatttgctatggttttagaaaagctcacaatatttcgtcaggcggcgaacaaaagatgtaatattttcattaaacttccggcagatatagatgaaaaagcactggatacagtcatttcgcttgcatataaatactctatagagggctttatagccacgggacctacaagggatcgttcaggattgcatcaggcagaaacaaaacaattggagaagattggcaacggcggggtgagtggccggggtattggaaagaaatcgcaggaagtagtgcgttatttatccgaacataccgatcggcactttctgattatcggagcaggaggaatcatgacagccgaagatgcagccggaatgatttctcaaggggctgacatgatacaaatctattcggctttcatctattccggtccgtctattgttcataagttaggaaataaacttaaaaacgaattgaaatgaagaatttaatttgtgtaagcctgtacgataatttatcgatgaaggcatataacttgtcggaagtgaataataaagagctgatggggatagtggaaaatgctcctgaaggaactttatttgtttttaccagtgaaaaatcaaatggtagcagtgttattatgtgtcccagcggcggcttcttaaagaccaatttggaacatgaaggtcttgatttcgccgaatggttcacccaaaagggaatgacttatgtgcttttcaaatatagaatgcctcatgaaaatcctgatattcctagacaggacatccggttggcattagcagttatacgagaaaaattcccggaatttggcaaacgggtaggagtaatgggagcttctattggtggatatttggccacttgttcggctacgatattatctgataaggaaaagcctgattttcagatattgatgtacccggtagttagtattgatgatcgtttaacgcatcttccctgccgtgaacggatgtttggtcactcttattcaccggataagatggtacaatattcaccgattgaacatgtcacttcaagtacacccgtcgcttttatagtggctgcctcagatgacagtgtggtcagtccccagaatggaatacaatttgctgcccaattacagaaatctggtgttcctatatccttgcatatatatcctacaggagggcatggatttggttacaatgatagctttgtgtacaaacaggaatggcttcaggaactcgatgtatggttggagaaattaatttattaattcttttagttgccatactttgaaatatacttcttatatttgtcagtagaatatttaataataagaagttatgaaaaattttaatgttacatctatgctagtaatgctgatgttcatgtgtattacaagtatgcaggcgcagagtattactcccagtaagaagtatatcacgaaagaactgaataatgtgagtaatttcagttcaatcagggtcctgggtagccccgacgttgagtatcgtcagagtagtgattctaaaacaacagtttctatatatggttcggataacctggttgacctgttggaagtatctacggtaaatggagtgctgcaggtaaatataaagaaaggcgttaagattcttagtggagaacgccggttgaaagtgattgcctcttctccttcattagatgatgtagatattaaaggctcggccgatgtatatctgaaaggtaccctcaaaggagctgatttaaatctgaatataacaggttccggagatattgaagctgagaatttacaatacaccaatctatctgcttttataaaaggtagtggagatattgatgtgaagaatgtgaaggccactactgtaaaaacgatagttagcggttctggtgacgtgaagatgaaaggttccactcaaacggctatgttgactgtgaatggttccggcgatatcagtgccgacaaattgacggctactaatgtagttgctacagtttcgggttccggtgatatatcttgttacgcttccaaacagttggacgcaaaagccagtggtagtggagatattgaatataaaggaagtccttctattgtaaataagcaaggcaagaaagactcaatttccggcaagtaaaaaattagatcccttacaggaagcgggtaaatatgtaacatagcacatatttacccgcttttgctataaacaaacataatacatgataattgggggcatacatttctgggagaaaggtgaaaacgagtagaaaaataagtaagcaaacgtaaatacggttttaaagctattaaaatagatgaattccggcaacaaacagatatactgattgttgtgtcaatgaatcattcgttttttttattcacctgaaaaaatacagactatggcaaagaattctcccgatgaaggaaaaagtacaaagatggtagaaaagcaggtagatccctcttttaacaacctcaaagagtaccgggcaaaaagacaattcagtgagactccggaaccgatggcggataccgtggagactccaagccggatacctgtttttgttgtccaaaagcatgaagccagtcattttcatttcgattttcgtctggaagtggatggagtgttgaaaagttgggtggtacctaaaggcccttccatgaatccgaaagataaaagactggctatacaggcagaagatcatcctttgagttatgcacactttgagggagttatacccgaaggcaactatggagcaggtacagtggaaatatgggatagcggaacctatgcttacgtcggtaataatcgtaacatatccgctgccattaaaaacggaatacttgaattcaaattacatggtcataagctcaaaggcctgtttactcttatccatactaatatggacgaccaggacagagactggttactaatcaagaaagatgatgtctttgcagtcactcatgtctacgatgcgaagaaaattccattgtatgatgaggtatttctatgatatatatgtttcttatgattaaacgatactcacttgcatatataattttctaattatatatgtagctttataattcaatatactctattgttttgatgattcaattaacttttatgatattatgaccgtattatttacgatgaaaataattaactaatgaggattgcctgggtaaaatgaaggcttgatggtataccctcttaatatttcggtaacaaaagacattgttaccatttttgatagaaaacacccattgtttttgtcggaaaccacctcctgtgtatacattgaaaagtttatacttgcatcgggttttaagcacgttaaaagattcttaggcgtgttttactaaaggtgtaaaatattaatcaaatccgatattagtatgaatgattgttacctgaatttcttagtaagcttccgagctttgttttctttagatgttggagccaatttagtaaacagtaaacaaactattggcatcattttacccgatttgtcgttgctcggatatgcggtccctgtggaaagtttcggcattgggctatttgtgattttgtttgcctaccttataatagaatacaatgtgcagttgttatcacatgaaaaatttaagattgctatgaatatgctccatactgcacatacaccgttaatattgttgcggaatcaattggaagaacttaaaacaggcaatcttcctgaacccctttcccaacaagtggaagaagcattgggatatgccgaatgtatcatatattgtaaccggaatattgcaactctaaataaagtaaataagagaattcctcctaaaacgtcaacggtaaatttggaactttccacttatgttacttccattgtcaatcaatgccgggctcatgccaattcccgccagatacggctgactgtcggtgaatgttcggattgtgtcagttgcaggataaacgaaaatataatgactgcagcacttcaacatcttatcaacaagatgattttgatttccgagtcaggctgttgcatatcgatcaacgtaacccacacaatgaattcctggcagttgcagattagcaataacgaaatagccgggcaaagagcagggaaaatgtttccctttattcctattatatttcccgtgtatggatatagtgatttatggacggtaagaaaaatcatccgtctgcatggcggaaaaataaccggatgcagacatggtaaagctgctactttccaaatcgttattccgacagactgccattgccagaatcagtcatgcccggtattgaaacattcttctgcaaaaacgaagacccaaatagatgattcctgcgagagtcctaagagcgataaacaaaacactaaagcgagagaaacttctcatatcctattagtgatggcagataagttattcagtgattatttgaagaaaactttatcacgctattttcagatttcagtccttgataatccggagctgctaatcaatacagctatcagtcaaaatcctgatgcgatcattattgacgacaatgtgaatggaataagcggagatacacttagtactcaaattaaagaaaataaaatgatgggctacataccaatcattcttctattaagaacctttgacagcgaaagctatttatctcatttagagagtagggcagaccgtctggaattacgtacggaaagtatttgtaaacttagggcagacatacgtatgcttgtcgaaaaccgcatggtcttgcgcgaacggatcaggctgtttctgtcagatgccatttctccgatgataccctcaaaagccgaaatagaaacagaaaatgccgaccggaattttatggataaagtcaataaaatcctggaaaaaaatctctctactgataaatatacaatagataaattaagtcttgatataggaatgagccgtactgctttttataataagataaaagagattacgggaaaccctcctgaagagtatatcaattcattcaaaatggacaaagcacttaaattgctggcttcccagcagtatcgtatttcggatattgcaagtatactgggctattgcgatgctaaatattttggaaagaagttcaaagacttttatcatgtatgtccgtccgattatataaagagcattgttggataaaagagtatagaaaacgagggtgtccaaaagtgaagtgcaccctcgtttctttatgcctttttacgttttttctctttgactgcaaatcttgttttatacagatgtaataaagtctgctttattgtatcatagtacttgtccaatccatagatctttaataacatcagctcaaagtcgattctatccttttgttgtaattccttttcaagaggtaatctgtctctattgaaaataggttgaaatgcttttatgatttctttcttttgcgcatcagacagtaactccggattgagtatcttgaaatccttcttgaatttagtttctctaaggtcaagtgctcccagtcccctgccaaatccgaaactctcaatgaaaaacatactcaaaatattattcagtaatgcaagtaggaaaatcttgttttcatctttgtactgttcctttattgaaaagccaatcatccgttgatcgaagaaagaacgtttatcaagcatggctataaataaacttttgtcgaaattaatattaacgacaaaatctgccatgttttttgtgctcatttcataccaaaacatatttggtttacgtaaagctataggtaatagcttcttatttgttttatccatttggttttcaaaagatcttatccaattcagagtcccggtatgatttaaagtttcgagttcttcgatactttttgaacaacagaaagcctgcgtctgactagttgcaatgaatgaagatgctttctttaagttttttagaacaggctcaatatattcatcttctattccgtgtccttttgcaggataaaacatacgattacaacctcttctttctccacgtataaaatcgaaaaactttttagagtcaataagcttctcggctatcgtaggcaaccaattcaaattagcaaaatatccggaccatgggattccgatattttccaattgtttgatttcatttattgaataagattgaatattgacccaatcagactctttattaagaatgatttcactacttaatttcttaatatctgctatgttctcaagtttctcttttaatgtacagaaagaaattctcctgtctaaatttaccggatcagaaatctccctcttggttgctattaataatgtggtgacaacctttgcattattgaaccatcgtcctttcccggaaataacaacacagtcaatattgaaatatttttgaattaactctaagaatatttctccatagtctgttccaagccatgcattagaaagtattaatccaatttttccattgtctgagataatgtcgtacaagtagaaaggaatatatgcaaatatatcactctttttacttagtgtctttttcgctttagtctgttccttgattaatttattgatttcctttatattcggattgagctttttgatctctttctctcttataaaaggaagattagatatgatataatctaccttaggcagttgcttttctacttgatttccattattgggatctttaaatacaatagtttgtcctgcgtgcaactcaattacatccgacctgaagatatgcagaacttttccaatattgccgggattggataaggtcagtgttgatagctggataggaaatgaatgtttgtccgaagcccagatactctcaataatttgctcttgaccaatttcatattcttctttaagagaataagcctgcttaataatagttcccgttccacaacaagggtcgagggtaattccatcttttttatctatcgttagccttgttaataaatcggctagttgaggaggagtcgcaaattgtccggccacttttcttttggcataggcgatggacgattgcagtaagttttgcaagatttgaatatcaaccccttcaatattaaggtttgaaagaaatacatttaattgaactagctgcttccatgcattatcagatactaattcattagcgatattattcccaaaaatattccaaaaattacagtgctccgagatgttggctattatttgtagggcttcactgacagttgtatcgaaagtaattgtttcaataatctttgcctcattgaaatgccgtttgataatgttgccaaaaataatcttgaaaaaccagtcggtcaatataacctttgatagagtgggcagtttatgcttagcgtcttttggggcttgcgagctaaatccatattctgctgcagaagagagccaccaattatctatttgcgcatcgagtactgcactactttttatattctcttttatgttttctgctgtcgaatctatattttcgagaacgatatcgattattttatcaattgccaatatctcggaagatccactttcagttatttctccatgctcgaaataatcatttaaatcttccagaatggtatgtagaagatctttccaaagattctcattttctttcacctctgaacgcgaatgaaggtcgatactattccatgatttcaagatagaatatgtattccctttcttaacatacaaaactgcgcttgtcacattccaaagaataaaactattattgtgcagtatctctgattttatcttggcgttatttattaattccgtgtcggttataggggtatcaggcattttgagttcccatccctgcaaaattatctttttagcagagtctttgaagataagcacatccggaaataaactcgatttttcatttctgattgtattctctcctccggcactttttacatgccaacttttgttagccaggtaaagattgatttcgctaatcacatcaatggcccaacttctttcattatagttgatttgtggcatccgtttctaaatagtttaaggtgtgatattttgtgattggttttttgaaaagtttgcgagtcgatggagtcacttcttctctttttagtgtttctgaaatcctatccatacaaatcttgatatagtcggtaggctgtatcctgtgcaataatacatcttcattcttttctattccgataaatcttctgttttccagaatggccgacagcaggaaactaccgcttccgcaagcattatccagaatgatatcccccgggttagagaatgttctgattaaatatctacccaattcaacaggcttttgtgtcggatgataaacttcgccttccgattcggccgtttttacatatacaaagtcgtcatgatcctcctcaaagaataccacatcattgggataacgttcgccatcactttttacatgctgtggcttgaactccccataactacctgtatattgatcttttctgacccccttgtcatacgcttcccctttagtcatttgcggattgtataccggctgttttttatagaaaacacaaacatcttcgtgtttacgaagcggttgttttttggcatttaaaaagttggtcggttttgatttgatccaggtaatcttgtatttgaataatttctccttgcttaaaatcaatttggctgtaaaaataccttgtgcggttaaaacgatcgccccattgtctttaataatacgttcgtattcagcccaaagagcctgcaaatcaatcacggaatcccatttattttgtgtagtaccatacggtaaatcacaaagtatcatatctatggatttatcaggaatggatggcaatatgttcaaacagtcgccctgaatgactttgtttacaaaaggtttgatgtctttcttctgttttttctttttttgtatgactccttctatcaatcgtttatctttctcttttatatctttggatgtagaacccatggtttgcatattaaatatttaaattgtcattttttgtcaaaagtagaaataataggattatctcccaaatttattatatgaaataatggtatgaatgaatctttttcatttcatatttcgaagagtatatattcgatttgattatctttgtttgatttttgaaactttgaatataaagataactacgcttatgttacagaaaacattcttagcacgttgcgacaatagggcttgtctagctaaaacaaatataatgagtggctcaccggaggcttggctgtctaatgatttattatccaagtctaatacgtttggtttgactttcgatttctttgttgattgggcgattaatcgaatttctccttatgtctggattaaaagaatactattgcctacctatacttatgatgaatttatcggtaagttggactttgaaatggaaaaagaatttggcaaagattatctatgcagactgggacggttcgcaacaggatatgatatgcaagtgcaatttattgtattccatgatgagttggattgggctaatgacagaagtgaactgataattgtttctttatccttcaaggaagggcattatagcttttctcctcaaaaatatagcttgtcagaatttaaagagctgataaagtctcattccggaggtcctgtttcaataggttccaaaggacttatctatggtacctcaagattagaatgcagtttgtctaagacagatagtttatatccaggtgatgcagaccttctacttttgaatgaagataataaagcggtttgcattcttgaatttaagaaacacacattatccagtcctatctcggagcaatgtttcacaaactattatccacgtcctgacggacgcaagtataaacgcttggccttattaagagattatttggcttctaaatccaacagtcgtattttattttttgttctttattatccaactcaaacatatattgagcaacaatggaaattggagataatagaaggtaatgcctttagtttgcgagcaactgatagctttacctttgaattacctgccgataaatcagataatgaatacaaaaaggttattgaaaaaatatctcaggtgattgctgctcatagctattcatgatgatgtaaaagttcgttgccgcgcactgattgtatgtgaaggtgggaaataaaaactatacaagttttgatgatacttgctacgcaacacatgatccctgtacaatggtttataaactagtacgcctgcttcgtggtgaggataaggaatttaataagaaaattatgaagggcctgatagaataatatcgcaaacataagattgtcttagaaattcaatcatcttatcctcgtgttctttagccaatttcattgtccaattttgatagttaaagtcagcgagtttacacattaaaaacatcttaatgctttgcagtgatttgttgctgatttgctcatggattcgggcaaactttatttgtatatggtcattactttgttgtgaattgaaactttgagaaatcatggcaagattgccaaatgaatgtacagcttcttcctcccattcttcattgtgtgattcgtcttgaggatgcagatgttcaatagaacgatttctccgaaacacatagtgccctacaatcttctgttcttcttcattgaagaaagtgctgcgttgttcccaaaggtaatagtctaaacgccaaaaccagtacctaatgttaccggatgctttatatgaaagatcttttctggcaggtaatacgccgtgacgttcattatcttcttttttaaggaatgcgagcatctctgcacaggactggagttcgtcttgctctaattttctcaaataaggtttaagccaattgtagaaagcctccgttgaaacgtaaagcatcgattggtattgctttaatttatcattatcatcctttggacctttcagaattaaactgtaattaccctgcccatccttgatatctcttctaatcgtataataatcaagcagtagccggtaataaagcattttttcgtaaaattcccctgcagtgaaatgcgttttcagagcatcaaacttctctatcagtttatccggttgataatgactggctggttgctcgccaccagtacatacatcaagcaccaaaagaagaaactccggaaatgatataatactgttttcgccatcttcatagctattctgtttaaactctattttttcaggttggattacatctatagaatactcctcctcgtcatcgagagacgtatatctgcacttttctaaagcttcatgaaatcgtttctgacgacaaagacttatagcttcttcataaaattgacggtaacaagcctcgtcttggttttcttccttcgcaatgataggatgatccatcatggaggccagattccaaatatgcgtcaagtaatcctgttccttttctccccgcatcagttgcactttgagaatctcatgctgttctagtccttttccttgtgcattcatcgcttcaaaatatttattcagcgaagtggtatctgcaagatagcttgatggtaagtaagaaaagaaaaatgtcaatcgtgtgaaaacctgttgcacaaactcaatccgttcctcctgagtattaaaattggattctaagaaaccttttatagcggcgagtccctcttccatattcttattgacatacgctttagtcggataacctttgatcttgctctttatatatgccttatcatcgcttctcgctatgaaattaaggcgattaccatccattaagaaaccggaccatttatcatcatattccttaaaaatgatggcaaaaagagttatgactgtaaatcgttgctgaccgtcaattaagtcataatgatttttcatatcaatacaagtaagcataccgagataatatggctcatcggcaggcatctttgcaaaatgctccttaagatcaaaaagaagtttggtaacctctttctttttccatgcaaataaacgttggtaaagcggaatagaaaacttaaactgacttgtagcaataagttccggcgtatatttattctccatattcattgtttctcttttcgattattgttttatccgaaaaatcattcagctcacagaagatacgtcttaaacacctatagaatcgctctttgatgtcaccttcttgctccaatccactaatcctgatataaggaatggtctcggcaagaaaaaatgtaggcgaagatgcctgatctatcatcattataatttctgaatcttttgcgaattcacgaatcttataaaagatagcgcgtgtggtactatatctatgctgcgccatgattccagcaatacagaacaatgcttcagataaatattgatgtccgaattttataaaataaccgaacatgaggctttctataatatcagcatatttccaatgagactcccattgaagatgattccttagtagctgtatttgcctggtacggataaactccttgtatttatctacaaaaatagaagtgtatgcgaagaaatgcgaaccaccttggattttctcatagaaatagaatttctctccaaaagcaggaatactggacataatgcgggcagccgaaaactcttcctttacctttcgtggctgaaattcctccacattatgcttccgcatccattttcttaatctgaaaagatgtactcccaaagtatgggtaagataagaatctccattgttgtcatattctaatgagagatcattccaccgcatagcaaggtgttctgcctgatcctcaatgtttagatagcgtagatggtgcgcttttagcaaatcatagtctgaaagcgatacaccctttgaattctgatttgagaagaatgtatatgccagatcaagattgctgtcattaagaataagtacagagaaaatcaagtgatgggacagacgttccaacatggctatgtctgtattcctctgattgagaattctaatcagtgctttgttattggctacatggagacgcgcatcttttgatatgaatttttgtttaagcaaaggcatctgccctgtatatcctaattcgcgcataataagcgttaaagtgacaaggcgttgttgtccatcaattatgttgtaaagagtgcaatcattcacagttcttctttgtaagatgatagatcctaaatgatagtcactgttgtgaggcatttcaagtaaattatcccaaaggtctgtaacatttttatcttcccagcaataggttcgctgataatcgggaataaccaaattggaagaaaataaatcttgcaaattttttgtttccaaaacgaccttttcttgagaattggtaagttctttaaactctaattcccgtgtatatgggctggaaatctcattttttttgtgaagattgaatttatcaatacaatcagtcagcaacggatcgaaaaacgttatcagtttttggaatgcattctttatgtcctcccaattattgattgtaattttaatactgcatcgtcctttacattttccccattgatgccatgataaatcaggattggtctctgtctgcttctgtaaataacgtaaaaaacgcatatagtcagtttgagtatagcgtccttctatatgaagttcaactagtccattccattcattatctatacgatattcataatgaatagaagagtcatttactggagttgagatttggatatatctgttatattgccaggttcttgaaggaaatactccatggaattttttatctacccaaaaacctttcagataattatataagtattggtctatgttacagtaattagccatatttatttaatcgcttgtttcacaagactcatgatatattctaaatatttagtatccgagattttgagttcataatctccattaccaaaatgtccgacagttgaaatatcccttgttaattgcttactatcttctaaatgtcctttggctacatttatagtaagctttattccatttttctggatttcaagtgcacaaatatggctgttggcctttttgaatgaaatataccacttttgtggtttaacttcaatttctgtattcaaattaagaattgcattcttataactctcgtataattctactacatcatcagattttccttttaataaattttcctccgaatactctttaattttctctgttacttctttaaattccggactattctgcatcacagttttaatacttgccgatgcgtgacttttacgaataggggtgatgaatacactatcattctcatagcgcttcacttcccataactcaatggataaatctttgaagttgacggcctctcgttggttaggcgtgaatccttgtgaaacaaaaacgacttttgtctgcgaccagtccacatcattccgtttcaagttccctgcttgtgtttcattatattccagaataaaatcagcctgattttgcagcattaggcttaggtaagtaaacccttgatctatgacactagagtttctttcccttttatattcaatgataacaaaagacttcgattgaggatcaaaggcaagcgtatcaatacggcggtctttaatcgtaaattcggactttatcatttcaagtcccatgatttcggacatattagtttcaaacatacgttgaatatctctttccaatttaaaaggtttttcctttatttcagaaaagacgcctgaagtattatatttgtaaagtgccataattttattttgaattgtttattgctgtaaaggtaagaattcttttgatattactatttcattcttcactactttcttctattatacgtattgttatagcattaatcatattgattataattttacccgtatttaatactatgatacaatatttaaaatcataataaaatgtgatttaggctttctgctttgggaaaatatatttttgctgtaaaatcgcaatatagtgtgaatattgataatcaaatagactcattgcgggatagtatttcgtttgtgtatccaattgttgaagcattttcaatagctacataaaagggatgtttgctgtttcgatactttttttattgccatactacttttgttttgattattaatgaagtttggtgcaaaagtaaaagcagggtgtctcattttatgtgacaccctataaaagaatcacctatttttctcctctttcatcatcttcctccacctctgaaacgccctcatcaaactttcttcttccactaaccctaccatattataatgttcgacaaaagtttccatcgattttttgaacatgatgccgtggcagtatttattttccagtagaaattcataaagttcggccctcatttctacttccattgctttttcaatgataagtgcactgttatgacctatataattatatacatttggatttttaccgtttctgggatgggggagggtgaaggtaatatttccggtttcgtgccatgaggcgttgggagggtggggaatggatagctggtggagagagtggtagatgggctgggtgtcgagaagatggatagcggaaagtgaggaagaagagcggtctggaggtacgtcgaggtgatttttgtagcgcatgtacatgtaagccgctagatagggcttgatctgaaaagtaactgtaaccattgtttttagatttgatttgtaaaatatttatcagtggagtaccgtatttgatattggtatccgttttctcttgttggaaattttgcttaaaaagaaaggccgaaaggacgcttttgtaatgctttgcttttcagatagttacataagtggattttggttttaaaccaacgggtcgttcctttaaaaggaacgacccgttgcacaccgagaaacacctcgttggttttaatgcaacgaggtgctccttaaaatcaagagataaagctagaataaatctctcgaaattttgaaatcatgaaataacttgtttgttttcgatgtaaataaatagtactattgtatatttacttgtttttatctatataaagaaatatacagagtgtcatatatgaagaaattttagatgaagtctatttaacatagtttaaatgagcctcttttatatttctgattttattttatgtttgagggagatttaaaatataattataatgtaactgaaaagtagaataggaaggaaatccaagtaaaatggctaatagtagctccttaaaatgaaaaagcactaagttctatcagaacttagtgctttttcattttctattcttattaaaataaatatatagttcttaaaatacaaattatatctatttttcggattgcatttgttaacagttccgatttggtattagataatggaacaaaagtatatattctttttgcaaaaaacaacgaaaagacatattttttttatggaatagtcatctaaattgatcgaaaaagtaaaatcaagcaacatttctttccagaattacatatttgatgtaaaaacactacaaaaacaatggattataattaagttctgatagaacttatctaagtgtaaaaagtgagtttaaatgttttagggctatttaataatttaaaaagagatttatgaagaaaaaattagcgctgctatttggatacctttttataggtatcgggctgataacagctcaaacgcagaaagtcacggggacagtgatttccgatgatgacaaacaacctgttgtaggggcttcaattgtcgtaaaaggcactaacttaggtacaataacagacatagatgggcatttcacattattggatgtaccacattcagcaaaaatattgcaaatatcatatataggaatgaaaacggagtcggttcctgttcagccgactgttagagttatcttaaagtctgatacacaactgatggatgaagttgttgtggtaggttacggatcagcaaagaaactagggtcagtagtcggttcggtaacaacggtaaataatagtaagatagccaacagaccggtagctaatgccggagatgcattacaaggtcaagttgccggtttacaagtatttactcccagtggagaaccaagtggaagtgttgtaatgcgattgcgtggagtcagttcgatcaattcaaatacagaacctctttttattctcgacggttcacctatatcatccggagcatttacagcattaaatccgaacgacatcgaaagcatgacggtattgaaagatgcctcttcaacagctatatatggctcccgtgctgctaacggagtcgtgataatgactagcaagaaaggaaaaatgggacagaaggcccgtgttagtatcaatgcacaatatggctggtcgaaaatgacaggagataatatagagatgatgaacaccgaacaatggcttaacctgcaggaaatgctagatccgggaaaagcatacgacactacatttcaaaaacggaagaagttctatatagataatggtatatctacagactgggcggatgtcttcttcggagatgcagctcctacccaacaatacgatgtaaatgtggttggcggttccgaaggtatcaactactacatttcatttggacattatgatacagagggaatcatggacgattcctcattgcgccgtgagactttgcgcagtaatgtggaagtaaaggtaaccgactggctgaaagccgggattaacgtgaacctttcctatcagaaatataacacgacaactttcggaacggaagctaacagcgtttataataaagcgtatgctgcccgtatttatcgtcctgaccaaacaataaacgagatattgacagacgaagaaggcaactttacaggttatgggaaacgattggactattttgacgatatgggatattataatccgtattacttggcagaacttcaacccaatgaccggagtacggtacgtatcaatggcaataccttctttaatataaacccaataaaaggattgaatatccgtacctcacaggcggtagatgcctttgattatcgtaactcccataaagcctatccggaaggcccctttgaaggggcaggagtggcgtccgagtcttttgaacgttattattcatttactttcaccaatacggcggaatataagttcagtctgtcagacaagcatcttttcaccgtgttggcaggacaggagtccattatcacaaagaatgaaaatttctcggcaacttctaaaaagatggtagactcacgaatgatgctgatggcagctggagcagagtcagaagtgccgatacattcgatgtatgacaaagttttcaattcttatttcggcacaatcagctacagttttgctgatcgttactatgtcgatctggcagcacgacgggacgggtcttccttgtttgccaaaaataaccagtgggcaaacttttattctttgggagccatgtgggatatgagaaaagagaatttcctgcagaacgtttcatggttgaacagtttacagttgaaggtgagctatggaacaactggtaattccggtatcagcgcctataatgcattggcattggtcggctccggtttgttgtataacggacaaccgggtattgctccttccaccgtcggcaatgataacctgacatgggaaagtatgaaaacactgaatgtaggcatcagtacaagagtgtttgaccgcttttctgtagaactggaattttataaccgtcagacggacgatatgttgatggggtatccattgtcatatactaccggacacggaagcagtgtggaaaatgtagcaagtatgcgtaatcgtggtttcgatattactctgggagtggatattctgaaaacgagagatttttcatggagtgtttccggaaacctgaattataataagaatgagataactaaactatttaacggattggatgaatatactttgcctgataccggtttgaagatgaaagtaggcaaaccttggggagaatattactatgtaagatgggcaggggtcgatccgcgtgacggatataatacatggtatgataaaaatggaaatctgacaaaaagctattcggaagaagatgcagtttttgtcggcaagcaacgttatgctccatggtccggaggctttggtacccagttcggatggaaaggaatttccgtcagtgccgacttctcttttatgctcggccagtatatgttgaataatgaacgcttttttacagagaaccccacttttgcaggctcggacaatcaaactgtagaaatgcttaccatgtggcaaaaactgggagatgtaaccagaattgctactcccgactccccgatgcagtttgatacgcatttactggaaaatgcttcatttatgcgcatgaaaaacctgactgtcgggtacacccttccgcccaaagtgattcagaaaacaggagtaatcagtaacgccagaatctactttgtaggacgtaacttactcacagtgactaaatataaaggatatgacccggaagtagacagtaatatccagttggggaactatcccaataccaagcaatattctttcggagtcgaactaactttctaaaaacataaagaatggtgaatatgaagaaaatatctataatagcattgactatactgacactaggaatgacttcctgtgatatggataaaatgccatacgatgctgttcctacagaggaagcgttaacaaccatagtcggttttgaagaagcacgtgccggtatctattccgtatatttaggactgacaggaggaagttatgtattagctccggaagttcaggcagatgcctttaatgcagtggcggatttctctaataaatatggtgagttgcaccgttggactttcgagagcaccaactctaccatagaaacaatctggtcgaactactatgccgctatcggacgtgtcaatttctttattgacggggtaggtaagattgatgagaacccggaaatcgaattgactgaaacccagagacaacagattaatgtatatgagggggaagcgtattttacgagagcatactgctacttttatctggctaccttattttgccgcgattacgatgtggctactgcggcaaacactccgggactaccacttcaggtgaaatatgagcctaaacttcctgctacccaatatccgggacgatcttcactggaagatacttacaaacaaatattggaggacctcgaagaagccgaagaacgtatagagactgctaagaatggcattgctgattatgacaggtatattaatggcgcatacgtgacagtcaacacggctcccaagaattgtgggaattatatcacggtagatgtagtgactgccttgaaagcgcgtgttgccctgcagatggatgactatgaaaatgcagccaaatatgcaggcgacctggttaattcgaacagatatccattatcgaacacagcaacagattttgaaagtgtatggaagaatgacaagggaacggaaaccatctggcagattgccatgactagtgccgacgatgccggtgtacctctggggactattttcatcggttatccgactacaaagaaggactatattcctacacaaacactgattgacctatacaatgaaaaagatatccggctaaagacttatttcggaaaatatcacttaaccgtatcgtcaggtaatgcagcagatatctatttctttaataaatacccgggtaatgaatattacaatgcattaggaagtgaaacacgctatttaaatcagccgaaaccattccgaattgctgaaatgtatctgattgccacggaagctaatgcaaagattggaactgcagctgctgtgaaaaagggtaatgacgctttgaatgcattaaaaaaagcgcgaatcgagggatggactgatgcaacctacgatcaggaagctttattaaatgaaatcatgaacgaacgcgaacgtgagcttgtaggtgagggataccggttgatggacctgaaacgttgggggaaaggtgtgaagcgtggaaaaccgcaaagcaaaggactggtgcttttccctggacaagcaagtactgacgggctggataaacctgtggatgaccagcggatgctttggcctattcctaaaacagaaatggatgccaaccctcaattggcaggtcagcaaaatccgggatattaatcaatgaataacgtaaattatcaaatacttgagtaaaatgaactatctgaaaatatacacccttcttctatgtgccgttctgatcgccgcctgttcggacgatgaggaacagttcaattccggagcggctacggtaagtttgcaggaaacagtaatgacagtgaaagagtctgccggtttatgcactgtgcctgtcgtagtgacaggagaacataccggaactatccgcgtgacgttcgaattaaaagatcataccgccaaagaggatgaaaactatattgtcaccacaaagacgctgcttattcctgccggtcaggaaactataaattttgagtttaaaactgttgacgacaaggttgtcaatgatgaccgctcttttgatattgaaattgccgatgtgaaaggggcatccattggtacaaacaatcgtctgacggtgattatcaaagacaatgattccagtttttatgaaacgctttcgggaacctggatatttaccggaacagcttctgctaccaatgcttccaatgtacaagtgggattctccgtaaaagtgaataccgcagaagaaggtacggaggcatacgaacattatctggtttgctcgaataagaatggatttgatccggataatgacattgagtgggaatttagctggcgtttgcattatgaatatgattcggcggcgcagaaaacctatttatctattgtaccgggtgaagatgtcgcttcttatggtccgtataccattcgtttcaggagactggcattagacggaagtacttctgacgtatatcgtggagaatatgatgccgaaactaaaacagtcacttttgagaatgccaatctaattggtgatatgtataaggacggactgatacaaatacagaaattcaggctatttggctgtaaaatggaacacatcagataaaaacaagattattaacataacaaataaaaagaacttatgagagcactaattgtctgcattacactgttgtttgctttgttaacctgtactatggcacaaataccatcggttaaggttgaagatactaagggggcacaagttaacactgcatccttggttaatcacaaaacgcctatgattatttctttttgggcaacaacctgtaaaccttgtattcgtgaattggatgccataaatgaacaattgcccgattggttggaagaagccaaattccgtgtagtagctgtttcgacagatgacagccgttctacagctaaagcgcgtgcattggcagagggacatggatgggatgattttatcatgctgtatgataaaaaccaggaatttatgcgagctatgaatgtaagcctgactccacaggtatatgtggtggatgctgacgggaaaatagtctattcacataccggatatgcgccgggaaatgagctggaactactgaaagcaataaaaaaactacagaaatagaaactgttattatccatagataaacgcaatgacatgactaaaataagaattcaggtgttggctttgttagcgttaacatcgacattgacctatgcgcaggaagataacaagaaaggttatctgacagggagctttgaaacgaatacgatatattacaaagatgatagtaaaacagaagcggaatcaccggaagatcatttcggatcgaacaattatctgaaactggattactatcagggtaagtttgccgtaggtgtacagttggaagcctatgaaccggtactggtgggatacccggcagaattggagaaagcaaagctgaccaattattatgtatcctgggctgataaggatttttccgtaacagcgggtacgttttatgagcagttcgggagtggactactatttcgtagctgggaggatcgtatgctgggattaaataatgcagtgatgggagcacgttttacctacaattacaagaatattgtggggttgaaagccatttggggtactccacgttttggtatggacttttccgatacacaagtacgtggcatagatgtaagtttctccttatctgaaatgcttagttggcaaaatacgtccttgagtatcgaaggaggggcgttgaaccggtatgagaagatcagtattgaccttgaagaagaaggaggaaaaccttattcgaacggtttttcggggcgggttaattttgaacgctccggatttacggcaaaaggtgaatatgtagatggtggcaataagtattatgatttcattcatgatgacaagctttatgcgaagaaacgtgccaatgcgcaactgttggaactgggatatagcggtaacgggttgggaataaatctgaccggacgtcgattggaatggatgaacagtgagattattgccggtaatggttcgacttcgaatctgttgaattatgtcccggctatgagtacgcaatatacctatatgctgaccaacttgcatcctcacactccacaaacaggagaggtgacaaaagcaatcagcggggagatgggcggacaactggatgttttttatcatttcaaaagaggaacggtcatcggaggcaaacgcggtttgaaattacatgcaaacttttcgtcctattatgctttagaaaaagaaggtacagcccagataggcaacttgtcattccgtgattttagtattgatgtggaaaagcaatggacgaagtcattcaaaatgaatttgctttattccatgcaagaatatagtccttcgtacggagcgaataaggcgaccaacctgtcgaatatttttgtagcagatttacaatataagttcaccccttctttttcaactcgcatggagttgcaatacctaactacaaaggaagatcaaaaggactggatggcggccctgttggaaataaattttgctccggcatggagtatttacggaagtgatatgtataatcacggcaaggagaaaatccattattacaatgtgggagccagttatgccaaatcccgtacgcgtgtagctttgagttatggtcgtaacagggaagggtatgtctgttccggtggagtttgccggacgattcctaaatatacaggggctaacctgactataacgacttcattttgagtttatcgaaacatttattaattagaatatagaatatgagaaaatttacaatgttttttatgtcaagtctgatatgcatgtgcggatgttttacagcgtgcagcggcaattcagacgacaatggtgaagagccggacaacggcgaagtgacaggacctattactttgactgtggataaagccaagattgaagctaacgggacagatatggcgacttttacggtgactgatgccaaagggaaagtactgacgacctctgaatatatgaagaatgtatattttgaagatgttactaccggtgattatctggagagacggaccaatacgttcgtgtcagtagaaaacgggactcataagtttaaagcatattatctggactgggagtcggatgaagtttccgtaaccgcacagaatcgtaagaattatgaacttttctatcgcaaggtgggtgtttttaaaatgaccgggacttggtgtacctattgtccggccatgacttcggcattaaagaaagtggaagaactgatgccgggacgtatggtgaaaatggcttttcattcttccagcagttcagcgactgatcccttccatttgtcacagacaagcaccatcatgagccgttttggagcatccggctttcctacctgtatttatgatttaaaagtgatgtcaatagacaggaatgtgagtgctatcaaacagacattacaaagccaaattagaaaatatccggctacatgcggaatcaaggtaaatacatcctataattcttctactggcgaaattgcggtaaatgctgcattgaagtcgagcgagggaggagaatatgacttggtttatgtcttggtgactgatggcttgacagcatccggaggaaatgagacctcgtatgactatacggtaagagctatttccaacaattacctgtcgatgtcaaccaacggacggtttactgtggatgcaaaccaggagcacactgccgctactttcagcatttctaatgcaaagaacctgaatcctgccacatcgcgtgtagtggtttatgcattacgtaaagtagatgacgcatatatggtggataatataaccgaatgttctattgatggtagtatagactatctctataatgattgaggcttatgaagaaattatactcgacaattctaccaattgtaatgatcctttgtttagcaatgctgtcatcttgttccggtagttcggacgaaacggagaatggagggacggatgacggcattttgcgtattacggccgataagacggctatacaggcagacggggtagaaaaagtgacctttacggtcaaactgggtacaaaagatgtaagtgaagaaagcacgatgaatctgattctggtaaaggagtcaggagaggaaaatctggattatggtgtccgtgctttcagcacttcagtgccgggtacgtatgtttttaaagcccgctattatgagggaaaagcaatggttagtgaaaatgaagtgaccgttcaggttgctcccgtatcaggagggaccagctactatcataaattacttggaatgcagtttacttctgtcggatgtcaggcttgtccggcacttagcactacattgaaagcaattcaggaggaacaaccgggacgactggctgtagcttctttccacatggatttcgggggaatgacggatcctatgagtacagcagctaccaatagttaccggactaatattctcggtaatttctccggactacctcgtctcttttacaatctgcgtaaaggtactaaagaaatgatcagtatcaagagccagattgaagaggaacttcaaaaagaactaagtaactatccggcttcttgcggggtagctattgagtctgtgtataatgcttctgaccgtacggtgacgattactgccaaattaacttccaatgtaacaaacacttatcgttgtttgatttatctggtagaggatggaatcaaatactttcaaacgaatggtgggaatgattatacgcataataatgtagtacgtgcagtggtgtctacatcgttgaatggtgaccgtttcaatggagaagtaaatgcgggaatagaatctaccatgcaacgaacttgtcagttggaaccgggatggaatgcggataatatgcgtgtgattgtgtcgatgttgacaacgctggatggcggaaaaacttatacgtgtaacaacgtaaatgagtgtaaacttggagaatcggcagattacttgtataacgaataaagacgagttatgtgtataaatgtctataaaataatattgctggtctgtatatgctgtgtaggaatcttctggatttcctgttctggcaattccgatgattcggagcagacagaagtgattttgagcgtcaataaaaatgcgttgactgctgacggaaaggatgttataacctttacggtaatgcatgcgggaatggatgtaactgctgatgcaatcatccgttccgtgatggacggacaaactttggatggaagtacattttctacttctaaagccggaacctatgcttttgaggcatcttatggtaactatgtatccaagttggtaacggttgttgcgagtgccacaccgggtgaaccttctaagtttgtaagacgcgtttgtgcaatggagtttactgggacgtggtgtgccatgtgtccggcaggaatgactcgcctgaactatttgataaattcgagttatgagggtgttgtttatctgatgtcatttcatgtcgatggaacaagtgctgatccgatgacaatcgaacagtcttcgatcctttccagaaagttttctatctccggttatccttcatgtgtggttgatatgcgtgaggcaatggggctgtctgaaaattatagtgtcatgcgaggtgtattcaataagtctttggaggagtatcccgcatcttgcggagtggccatccagtcacaatataacggacatgcttatgtgacggtaagcgttaaatcggaaaaaaacgctgaatatcgtttgatcttatatgcggtagaagacggattgaaatatcaacagaatgacgggggaatttatcgtgattacacacataaccatgtggtacgtaaattactgtctgccaccgttgatggcgataaattgggacttatagtagccggtaaggagaaaagcataagttatacagttatcatggaagaaggatggaatgcggagaatctttctttttatgcattggttaccgatgaaaacggatatgtaaataatttggctgtctgcaaggcaattgatggcgatgccgattatgaatatgtaaatgattaatcacatttatcacttttaattatgaagaagaaattatttagcttattactcatgttgggatttatctttgtggtaagtcctatggtcctttcgtgttcggatagtgaagaaccgggtgtagaacctgatgtaccagtgaatccggatgttccgcttcctccaaatccgacaccaataagatgggttgagaatgaagtggacggtggcgaacgtggagtaggtataaaagttaccagtaacactgaacataattttgtatttgagtgtactccgggttctaaagtccaatcttatcggttggatgtatatcctttatgtcgtatgtacaattacttattcgaaagtgtagggacaggagtacaagcaacagaggaagaggtggaagatttgataatggaagctatctataattccgaaggtgcaggtgcatatacgtttagtagatctacattgggagacagttatccgaatgcagaatttgactgggccaattcgaaatattcccaatcggaaatcgtacccggagcagaatatctgattataactgtcggttgtaatgatgaaggcggacagaatcctgcagatatgaaaatctgttatttgaagactccggttcaaagtgtaataggcactcctcgtgtggatatcgatgtcacaacaagttatcgtgccgttggtattcaatacctccctaatacggacagtaagtatttctatcagttttgtggagattctgaacctattgatgcatttataaatacgtatggaaagtcgatgtatatagactttatgagacactggattcaaaaagcggaagatgcacaggttcctcaagaggaattgtattatacggtggattttggttatacagcagatgcgaaaagaatgataaccgctaccagcatcggactggatgagaacaagactccgggtgaatatgtccgtcaggattttcatttgaaagaaatagacctgaatgcagaattgccggaatgtaatctggaaattagtagaattggtgcttccatggttgatatgaatgtggaaatgaaagacaattgcgttgccatgttttatcgtatattcagtgcttctgactgggctccttatgaaaatgcagatgaagcaaccatgaccactttggcacgaactttagaccaggagggatggggtgtgaaaaatacgaatttcgctcaaaaaggttcctataaaggtacagaattccaatttgatttgcttcctgatgctccttatgtagtggcttacattgggcgtaatgagtatgggcagttatccaaagaagtaaagcatgcttcattttctaccaaagcgcgtattactgatactccggatgcatctgaagctgatattaatataacgatcactgatccgggacgtacaagtctgaaactgaattattcatataatcagaaaacagccgtattctatcatcagtatattatgacaccggatttactggaagatgctaataaagcggaattaatcaattatttattgtctgcggattccaatgtatggcctgctaatgcgacaggaggagtggaaagctttacctggacaggattggacccggctaccgaatatatatttgcatatatggcggaagactggaatggcgtattgacggatgtgaagattgtaaaagctactaccgaagcaattgtggcaggtccgaatccaactatggaattacgtgcatatatgagtgaaatgaataatttcactgtccagttttccattataaaggatgtggctaaagtttatcatacaattcttgaagatacgtattctgcaagtggtgattatacctatcaggagtgtatggatgtatggaaggaacattgtttggattatggcttgacaacagtaaattcaacgactcaatcatacgataagacaagtgaagccaaacgtttagttgctttatgtgtaccaattggggcagatagtgatggcaatgaagttattggtgatctttatactgtattctatgataaagataaaggtatcattactgatccttctgtattgttcccggatgctccgaaatcagtaaagggtatgataggaacaacaaaaccacaaattataaagaaagatagacggattcctgcaaatacgattattaaggagaaagtggataagagtactcctggggcgatgatgagcggaagtactatttatcttgatttgaagaaactgggtaaacatcctcacgccaaataaatagtattggcacaattattccgcacgatagcgtgaaagtctgtcgtgcggttttctctaatcatctaaattatcatggatatgagaagaaaatatattttatgtagtatggggaaatatgtatgtttcctggcagtatgtgtggtaatgttgtcgtcatgttataatgacgatgatttaaaaaactcaatttccggtctggaagaccgcatggataagttggaagcttcgttacaaagtgtacagacggatatttccacattgaagacactgacagatgctttatctcaaaataaatcaatcgcttctgtattggagaatgaagacggaagttatacgattaagttttcagataagacagaagtaactattcgtaatggtgaaaatggggaggatgctccgaaaataaccgtgataaagaacgaagaggatggtatctattattggggaataactagtacagacggtaaaaagacattcttgaaagatggagaaggaaaaatgatgcctgtaacggctgccgctcctaagattcgcattaatacgaatacgaaagagtgggagatttctacggacggtggaaagacttgggaacctaccggtgtttacgcgtccggagaaggaacgggagatacctctctttttagtggagttagtcaggatgatgattatgcgtattttactctgaaagatggcacaatattaaagttgtcgaaatctaaggaactgaaatgtgatatattgtccggaaagcaatactttacgaacggtgaggagaaattgatttcagttgaaatgagtggaatttcgaaatataccgtaacaaaacctgatggttggaaagcttccctgacaggaaaagggctgactattactgctcctgtggcagaaaatcagtatgcagagacgagtggcaaagtagctataatggctgttgcatctaacggacagagtattatcgcagagattcccgtaatcataggggatgctcctatagttatatctactgtggggcagacagtttctactactttgacgaatggcatagaaatgtattatttgggagtattggaaatcaatgaatatagtgcagaggctgtagcagaattagtaaacggatatactgcccgtatgtatatgaagacagaggctcttgataaaatgccgttagctgaactgataggtaaggatcccgaagctggaaagacgtatatgatttgggcagtaccttcatctgaagctggtagtgcatatttgcctgatgatgtgattgccagcgtgattaagactgctgcaactgtagaactgaaggtttcggatattacttttgaaggtgcaacggtttctgcaattagaaagggatgtgacgttttttacacagggattgtagataagtccaattattcaccagaaggggttattgacgatttggcctttgggggcggaaccaaacagtattcggattataatggaccgttggaaggtaaagtgttggattttcttccaagggtaataccaggaacaacatacgtactttgggctatcccttataaagaagaaaaggggtataaaacagaagaactagtagcggtggagattcccgttcctgcgttgacgtatgacggagcagcgactgtaagtgttagtagtattgttgctacagtttcaagtgtaagtgcgaccattactcccggaactgactgctataagttctattattcttatatgaaagaacagactttggcaaattatggcactgacaaagaagttatttcctatcttatcaaaaacggagattcttccaaagaggcaaaaaactttgaaagagcttctttagaaccgggaacaaaaggctttttggttgcagtagcattaaatgacaaaggacaacttggatcattagtgaaagtgcaagccgattctagggaaatatcttataacccttcaatttcggtggatgtggcaatagaggcaggaactgtttctacgactttaacgctgaccccgaccggaaatccggtgaaattccgttatgtccacatgaaattgagtgatttcaaaagctatccgtattggggaaatgaagagacagtaaagcaagcattaattatgaatgataatgttactgaaattgttgctgctgaactgaagattcatcaactggtgattgaggatattgcatttaattcagaatatgtactgtttatgatagcagttgatgctgatggtaatccttcttcgactgtgacaaagaaggaatatacaagtgcaaagccgacttatgtgcgaaaagaaagggacgccgatttgtggaatgccagtgttccggaagtaacaattgacaagatagaaaaagacaaattctacaccgtttcttatactgtgaaaccgaagtctgcctgcaaagtcttttatgtatttgcagggccggcagattacctgactggtatgtatgatgaacaaatcaggtatgtgatgcaaaatggtgtaaaacaaacaacaacttattcgggaagtacttatggaacattgccaactaatatcaatgttacctggatagatgaagaaggacgtttttacgaggtttctaaaactgtagtagatgctccgacgcaataattttaatttctaatttaataaaataatagatgaaaaacttatttaatagcttttatagtgtagtattgcttgctttgtgtctgattgctttcagcaattgttcggatagtgatgacggaggagaagttggcggtacggacaatggaatcactgcaattagcagtgaaacggaaaagactgtttcactttatggggaaactgttgaaatctcgtttactgcttcaggaaaatggactccttctttacaatactctacaggatcggactgggcggctattactaataccagtggtagttctgctgccggtaaaggaggattcagggtaaaggttgataaaaatgaagccggacagaatcgtatattaacagtgcttgtgcaagttgagggatataaaacacctgaagttgtatgtactataacacaatcaggatctggtgacgtatcttctgcggatattgctttaaatgaatttatgcataactatttgaaggaacattatctattcaaggatgagtataatacactggaagttgattgcaaaaatgtttcgtatgataactttttatctacctaccttttgaagatgaaaacaaatacagaagatggaggaatttcccgtgcatattctgtgaatgccggtcaacgttatatttattcatatattgaaaaagtaggttctagcgatactcgtgccacaactcgtgctacaagcatggtaggaacaggattaggaacatttttctcttcctatatggcagatagaacgacaatcggcttgtctattggatatgtatttgttgattctcctgcagcaaaagcaggattaagacgcggtgatgtaattgttgctgtgaatggggtaaccttgaataaaaacaactatcagcaatacatgaatgcattatattatgcaagtggaggggagtcattcaatattggatatagacgctatgtgcctaatgaagatttgcaaaaatatgaattagtagatggaagtgttattttgacgacaggtacttataataacaatccggtactttattctatgtttataaaagaaaaagaaggtaatttgaatgtggcttaccttgtttatcaaggttttgatttgaattatgcggaagagttaaaatatatgatacagcagttcaaaacggaaggtattaccgatttaatcttggatttacgttataattacggaggtgcggttgaattgtcacgctatttatcagcttctattgcaggttcttcacatcgttctgatgttttcatgaggatgcaacgtagttctggtgcagatgaatatattcggtttggtgatggagatgatttaggtttgaattccatacggattatctgttcggaagagacagcttcttccagtgaattggtaattagtggattaagaggaattgatttccctgtaaaactatttggtagtcgtactgaaggaaaaaatgtaggtatggaggtacaagagtataaatatggtaactcttattacgaatttgctccgattactttccgttcgttcaatgcaaaggattggggggattatgctgatggaattgagccagatgtaatgttgaataatcaaaatgcagactatacggatgatattgataatgcgtttccgtatgcttttggagattgggataacttcgatttcaatttaccgttatggtatgctttgtgtgatattcaaggagtggaacccaatacaggcaaagctaaagttcgcagtggaaagatgaaaatggaacgtccacaaatggatggaattcaaagattaccatctgtgtctgtgaaacgctcaataggaacttttggctctgttatttataataagccggaggtagaaaacttatattagtaagactaaatctcttgtgaaataaattttctcttaagttaaaggggatgcttctcggtaaggtgttagtgagggcatccccattttgcttcataaatgtattgagaatgaatatacttaaacaaatatatgagatatatgaatatctgttttatcgaacatatatatggcagcttagattgtggggagaaaagcggtcgccagaagtagcagggttattactaccgacctcattgtttacttttgtttttgttggcccaatagttggagtattacattcattggaagtaccaaacaatgaagagttaggtatacttttggctgttatattcacttttgttgctcatagattatttattagcgatggacaatatttgtctattgctgataaatatcgtaatgaaactaaagaaaaacaacgacaacgtatgaagcaagtttggatttttttagcaataaatcttatttgggtaatattctgcatcttcttattcatcaaagtgatacccccgccatcaaatgcagatacctctaataagaatccttctccagaatatatagagatgctgaaagatataagagaccgacgagcacaatagaatataaacagcgaaataaatttgttgtataatagattataatttagaacttagaaaatgagaattattttatttttattagtaggttggtacactatcgggaatatacaagcacaaatcaaggagcctgtaaagttcaaaaatgagttgaaaatgacctctgaaacggaagcggaaatcgtgtttactgcttcgatagagaaaggatggcatgtgtattcgaccgggctaggggatgatgggcctatttccgctactttcaacatcaatgcgagtaatcatgtagaaacaatgggtaaattgcaacctgttggaaaagaaatcagcatctatgataagatgttcgagatgaatgtgcgctattttgaagatacggtacagtttatccaaaaagtgaaatttacaggaaatgattactttatggatgggtttctggagtttggagcttgtaacgatgagagctgtttacctccgactcaaattccttttaaatatgggaaaaaagcagaagcagatttaatagttgcaaaagggaaagaagaggctccggtaaatgtggtagagaagcaatcggaaagtgatctttggaaaccggtaatcaatgaattgcaagtgttaggtgaagaacattctcaagaggataaatcttggttgtatgtctttgtcactggatttcttggcggtttattggctttgtttactccttgtgtatggccgattattcctatgactgtgagtttcttcctgaaaagaaacaaagacaagaagaaagggattcgggatgcatggacttatggtgcttcgattgtggtgatttatgtaacactgggattagcaattactttaatatttggtgctagtgcattgaacgctttatcaacgaatgccgtattcaatattctttttttcttgatgctgattatttttgcagcttctttctttggggcatttgaacttactttgccttctaaatggagtaatgctgtggatagcaaagcggaagcgacgagtgggctgctaagtatttttctgatggcatttacgttatctctggtgtctttctcttgtacagggcctattattggatttttgctcgtacaggtttctacaactggtagtgtgattgctcctgctattggaatgttaggctttgccatcgctttggctttaccattcacactgtttgctctttttccttcgtggctgaaatcaatgcctaagtcaggagggtggatgaatgtaattaaagtgacattgggctttctggaactggcttttgccttgaaattcttgtcggttgcggatttagcttatggctggaggattctggacagagaaaccttccttgcattatggattgtgattttcggactgatggggttatatctgttaggaaagatcaagtttccgcatgacggtgatgaaagtagggtaggcgtagcccgcttctttcttgcacttgtctctttagcgtttgctgtgtatatgatccccggactttggggagcacctttgaaagctgtcagtgcatttgctcctcctgtgatgacacaggactttaatctatattcgaatgaggttcaccccagattcaagaactatgatattgggatggagtatgcacggcaacagggaatgcctgtgatggtcgactttaccggatatggttgtgtgaattgtcgtaagatggaggcggctgtatggacagatagtaaggtaggcggtatcatcaatgatcaatatgtgcttatctctttgtatgtagatgataagactccattgaatgagccgctcaaagtaacggaaaatggaacggaacgtaccttacgcacggtaggggataaatggagctatctgcaacgtgtgaagtttggagcaaatgcacagcctttttatgtattgctggataatgacgggaatccgttgaataagtcgtatgcatataatgaagatattacttcttatattgagtttttacagaaaggattggaacattatgtaaaatgaatttagtcattgattctctttttaacctggactcgtgatcgataggattagaaaaggaatttgtttttaggtagtgggaccggcatacaaagcgtgactttgtttgccggtcttttttatgctcccttgtccctctgcttgtcgcttttttccaggtattgggttgattatttgctataaatgctgtttgtaggctctgtagtgccgataatcgcttgtcgtttcatgtccgttgaatatgtcgcatctttgcattgttaacgttagcgaagtaattattaaacagtattcatttaaaaaaagaaaagtattatggcaattagatttaaaagagttcaacgtctgtgtgacccgacaaacaaagaggcaggaaagaaagtgtatccggtgatttcttatcaatatgatacgagcgctacactggatgagtttgcaaaagaaatctcttctacttccggtgtaagtgagggtgaaacaattagtgtattgaaagattttcgtacacttctacgtaagacattactttcgggccgttcagtgaacattaagggattgggttactttttcctttcagctcaaagcaaaggaacggaaaaggcggaaaattttactgtatccgacatcagtggtctgcgggtttgttttcgtgcgaattcggatatccgtctctttacgggaacttcaacgcgttcggatggattgaagtttaaggatttggatcatatcaacgactcaagtatcatcgacggtgattcaggcgaaggaggcgaagcaccggatcctgacggaggtgcaggaggtaatggtgaagcacccgatccggcagcttgataaacggaaagtcgggaattagcgattttgtatggaatggggcttcggcctcattctttctttataactacataaatagatcaatatgcaaataactacaatccttgcttttattactgctatgggtggtttggaagcggtgaaatggatggtgagatatatctcttgccggaaaacggatgcacggaaagaagaggcagacgtgagcagtctggaagaagaaaatcgtcgtaaaaaggtggattggctggaagatcgcctggcacagcgggacgagaaaatagacgggctttatatcgagcttcgcaaggagcaggaagagaagatcgactggatacataaatgccatgaggtggagttggcacagaaagagtcggaggtgaaaaagtgtgagatcagagggtgtgtgaagcgcattcctccttcggaatattaatgaggttagttgataaaaataaaatgtcatgagaaagatagattctattatagtgcattgctcggcaacaaaagccggacaggactttaccgccgcagatattgaccgttggcaccgggaacgtgggttcaacggtatcggatatcattatgttatccgtctggacggaagactggagaaaggaagggaaattgatttgcctggagcacattgcaaaggttggaatgagcgaagtatcgggctctgttatatcgggggattggatgagaacggacatccggcagatactcggacaaatgttcaaaaacgggtgctttatcaagtaataatggatttgcaacgggaatatactattcttcaggtattgggacactgggatacttcgccggatttgaatggagacggggtgatcgaaccttatgaatatgtgaaagcgtgtccttgttttgatgtgagggagtttatgaagagtgggagggagctgctgtttgttttattgttggggttcgttcttccgggggtgctttcgggatgtaggactaagaaggaagttatcagtaggagcagtgaggtgcagatggattcaagttcttccgggcattcttcccatgtggcttcgtatgatgttaatcaggaaaggaagatgctggaacggatggaggagtctaccgaacaaatattggtagtattggggaaagatactgcgacaggggatttctcttccacctgttttatttcaggtagcagaaagacggtgaataaggtttttgaaaagaaagagaggatagatgagaaagaagatactcaaatatcatctttcatcgacacgaatcatcataaagtggtttgtgaggaggaagagaatagcttatattataggaaaaatataagttggatgctaataattagtatatcggcattgatgttactttactttatttataaaaagaggagaattcttttttgaggatttgcatagaaatatatagaataatactatctttgtagaggtatatcgggcttaatggagtgattgttcaataatattcatattcatcatcgggatatacaatgagaatgagggcgaatttttctattgtgataattggaattgtatagccctaaatgtgcgaataacgtaaaagtggtagcttttgagtttgaattttgcatatactgaaacaggctattttaaaacattagctattagtcttgtttgtaaacagatattgttctcttaaacatgaatacaatttgccatattcgtgattatacggacctttgcagaaggtaactaacaaacaatattagggattaatgattatatataatagtcgattagcaaaatgtcttctcgataaaaaaacattcttttatgatttttgggtgctactttacccgttataagcaattagaattttgggaggaaatggaaaaccagattcatgtaaggcaatacatggaatactttttgcctgcattgttatcagcagtaggagtatcgctatgagtgaagctatcatcatcaagatgggctgactaagataaagatcccttgtggatcggctgcctgtgaaggtcgctctattgtttgttttgtttgtgttttggtgcacctttattctgttgaagaatagggtgcactctttttatggttatgtaatagtttaaatatatctttgaagaaaaaaagaagatgggtgaaaaagcttcaatgtggaatctttggcatggctgtcacaaattgagtgagggctgccgtcattgttatgtatatcggacggatggtaaatatggaaaagacagttcggtggtgacaaagacagaaaagttcgatttacccttgcagtgtaaaaagaatggtacgtataagataccttcgggaaatttggtatatacctgttttacttcagattttctcattgaagatgcggatgaatggcgtgccgaagcgtgggagatgatgcggatacggcaggatcttcgtttcctctttatcactaaacggatagacaggttgcaacagtgtctgcctcccgattggggagatggctatgacaatgtgaccatttgttgcacgatggagaatcaggatagagtagattatcgtttacctatttataaagaaattcctattaaacataaaattattatctgcgagccgcttcttagtcggattgatttcagaggtgagctgggagagtgggtggaacaggtagttgcaggaggagagtcaggaaaagaagtccgggtatgtgactacgagtgggtattggatatccggcagcaatgtatagatgcaaatgtcggtttttggtttaagcagacagggagttatttattaaaagacggacatgagtataaggttgcacgacaatttcaacattcgcaggcgagaaaggcggagttgaattatacacctgataaataagaaataaagattaatacagatcttttttactgaaagcgagggttgcttagcaatcttcgctttcgttttattgagtacaaaatacggataatcacgtctttttataaagatattgtgtaaattttaaattatccatattaatgaaacagataaaactgttacttcttttagcttccgcctccgttacgggagcacttgcgcaaagcaatggattgacggatatgagtcagagccgttttgcgaagatggcgaataccggaatcagtgccgtacattggacagatggattctggggagatcgctttcaggtatttagccggacttccctgcaaagtatgtggaacacttggaacacgccggagatctctcacggtttccgtaattttgagattgccgctggtgtgtgtaagggtgaacattggggacctccgttccatgacggagatatgtataaatggatggagggtgtggcttctgtctatgctgtcaataaagatccggaactggataagttaatggataactttattacttgtgtcgtaaaagcccaacgtgcagacggttatatacatacgcctgttgttatcgaagaactgaataaaggtattgactcccatgcattaggggatcagcataaacaaacggtcattggaacgaaagtaggtgacgagaatgaaaaaggagcttttgccaatcggctgaactttgagacatataacctgggacacctgatgatggcgggtattgtgcatcgtcgtgccaccggaaagactactctttttgatgctgccgtaaaagcaacagattttctgtgccacttttacgaaacggcttctgccgaactggctcgtaatgccatttgcccttcacattatatgggagtggtcgaaatgtatcgtgccacaggaaatccccgttatctggaactttcgaagaacctgattgatattcgcggtatggtggaaaacggaacggatgataaccaggatcgtattcctttccgcgaccaatatcgtgcaatgggacatgccgtacgtgcaaattatctgtatgcaggagtagcggatgtatatgccgagacaggcgaacaacagttgatgaaaaatctgactagtatctggaatgatattgtgacccagaagatgtacgtgaccggagcttgtggtgctctttatgatggaacgtcaccggacgggacctgctatgagccggatagtattcagaaggtacatcagagctacggacgtccttatcagttgccgaatagtacagcgcacaatgaaacatgtgccaatatcggaaatatgcttttcaactggcgtatgctggaggtgacaggggatgcgaaatatgctgatcttgtagagacttgtctttataatagcgtattgagcggtatcagtctggacggaaagaaatatttctataccaatccgcttcgtatcagtgctgatcttccttacacgcttcgctggccgaaagaacggacggaatatatcagttgtttctgctgcccgccgaatacattgcgtacattgtgtcaggcacagaattacgcctacacattgagtccggaaggcatttactgtaacttgtatggtgcaaatacgctgactacgacttggaaagacaaaggagaactggcattaacacaagagacggattatccctgggaaggaaaggtacgtgtaacgttagatagagttcctcgtaaggcgggtactttctcgctcttcttacgtattcctgaatggtgcgaaaagactacgctcacagtgaatggacagccgctgcaaaccaatacaaaggcaaattcgtatgcggaagtaaatcgtacatggaagaagggggatgtagtggagctggtgatggatatgcctgtccgtttgctcgaagctcatccgttagcagaggagattcgtaatcaggtggtggtgaagcgcggaccgttggtttactgtctggaaagtatggatattgcaaacggggaaaagattgataacgtattgattcccgctgatataaaactaactccgaagaaaatcacaattgaaggcagtccgattgttgcacttgaaggaatggcacgtctggcatctgcaacttcgtgggaaggagtgctttaccggccggttgttcaggctgaaaagacagtaaatatccgcttgattccttattatgcctggggaaacagaggaaagggagaaatgactgtatggatgcctcttgccagatagtccggattgtttagtatacagaaatgaaaaaaatcatgaaaaagttatttgtaacggctatatgtatcttgtgcagtcactggctattggctggtgagatatggatttctcccaaaggcagtgacttcaacgacggaacttgtcaatctcctaaagccacgctgacttctgccttacgacaagcacgagaatggcgcaggacagaggataatcgtattcaaggtggaattacaatctatatggaaggtggaacctatgccttctatgaaccggtttttatccgtccggaagatagcggaaccaaagaatcgcccacaatcattcgttcggtaggcgatgaaaaagtgatattgagtggaggaatcagcataaatggatggaagaagcaagggaaagtttgggtggcagatgtaccggtatttaatggacgtccattggatttccgccagttgtgggtgaatgggaaaaaggcagttcgtgcccgtgatgtggaagattttgaaaagatgaatcgcatttgcagtgtggatgagaagaatgaaattctttatgtacctgcagtttccattcgcagacttattgataataaagggaatttgaaagctaaatatgccgagatggtattacaccagatgtggtgtgttgccaatcttcggattcgttcagttgaagtgcagggagatagcgcggcaatacgttttcatcaaccggaaagccggattcagtttgagcatccctggccgcgtccgatggtgacgacggacggacataattctgctttctatctgacaaatgcccgcgaattgcaggatgtgcctggagaatggtatcatgatatagatgcccgtaaagtatattattatccacgggaaggagagaagatgcaggaggcggaagtgatcgtgcctgccgttgagacattagtacgggtggaaggaactttggatcgtcctgtgtgccatattcgttttgagaaaattactttttcctatactacatggatgcgtccgtcagaaaaaggacatatacctcttcaggcaggtatgtatctgacagatggttaccggattgatccgaaaatgcaacgggattacttgaatcatccgttggataaccaaggatggttgggacgtcccgcagctgctgttcgtgtggctgctgcaaagcagattgatttcgagcgttgccggttcgagcatttaggttcaaccggattggattatgaagaagcggtgcaaggcggtgttgttcgtggctgtctcttccgcgatattgccggaaatggtctgttagtcggcagtttttctccggctgcccatgaaacgcatttgccatacgaccctgctgaccgtcgggaagtatgcacacagcaacatatcaataattgctatttcacggaaataggcaatgaagattggggatgtcttgccattgctgcgggatatgtaggggacgtcaatatcgagcataatgaaatcagtgaagtgccttatagtggcatcagccttggttggggatggacgcaaactgtgaattgtatgcgtaataacagagtacatgccaatctgattcatcattatgcgaaacacatgtatgatgtggcaggtatttacacactcggttcgcagccgaaaagttatgtaacggagaattgcgtgcatagtatttataagccggggtatgtacacgatcctaatcactggttctatctttatacggatgaaggttcttcctttattactgtacgtgataattggacagaaggagagaagtatctgcaaaatgccaatggtccgggaaatgtatgggaaaacaatggcccgaaagtggatagtgttattcgtgaacgtgcgggactggaagcaggatataaggatttactaaatatccagtaggtattgacaagtcatttaactgtaatacgtgattcgttccacagatatggaactaaaggaaaacaattgtagaactaaagggaaacagatgtggaactaaacgtcaaccactgtggaacgaattatttcttatgattcagtttgttagtaatagaaagaaaaatgaaaaagaaatatatgatattgcttagtgccttgtctttggcaagcagcacatttgcccagacctggatatggtatccgggagactacgaaatctggctgggaaatcaaatgaataaccgtcgtacggaacgaggtgcattttttcctcctttttggaaaacggacagtcattatgttgtcgtagaattcagcaagcaactgaatctttccgagccggaagaaatctttattgctgccgaaggaaagtacaacgtcaaactggatggaaagctccagttcggtatgccggaaaccatgttgcttccggccggaaaacataatctgaacattaaagtctggaatcaggctactcctcccactatttatgtgaagggaaaaacagtgaattcagactcttcctggcgtgtgacttacgaagataaagaatggattgacgagagcggaaaagccagtgacacatctgccactatctatatggatgccggatgctggaactttgacggagctacccaacgtccttcccaattcagtctgatgcgtgaaccgcagcaacctgttacgaagtcagaacagtccgaaggaggtatcctttatgattttggaaaagaaacattcggattcatcacattgaagaatctttccggaaaaggaaaaatagaaatttattatggtgaaagcccggaagaagcaaaagataaagcatattgcgaaacattggacaaactcttgctcgaaccgggacaagtgaccgaccttgctatccgcagcacttctcccttgagtaattctgaaaacgaatatacattggagaacagcaaagccttccgctatgtctatgtaactcacgagccgggtgtacagattggagaagtctccatgcaatatgaatatcttcctgaagaataccgcggaagtttccgttgtaatgatgaagaattgaatcgtatttgggaagttggtgcatacaccatgcatctcactactcgcgaattcttcattgacggtatcaaacgtgaccgttgggtatggagtggcgatgctatccaaagttatttgatgaactactatcttttctttgataacgagtccgtcaaacgtacaatttggttacttcgtggcaaagatcctgtgaccagccacagcaatacaatcatggactatactttctattggtttcttagtgtatatgattattatatgtatagtggcgaccgccattttgtcaaccaactatatccacgtatgcaaacaatgatggattatgtgttgggacgtaccaataagaatggcatggtagaaggaatgacgggcgactgggtatttgtggactgggcagacggctatctggataagaaaggcgaactctcttttgaacaaatcttattttgcagaagtctggaaacgatggctttgtgtgcggaattagttggagatgccaatggtaaacagaaatacgagaaactggctgctgctttgaaagcaaagttagaacctgccttctggaataatcagaaacaggcatttgtacataactgtgtcaacggtcagcaaagtgatgcggtcacccgctatgcgaatatgttttctgtcttctttcaatatttgaatgaagataagcaacaagccattaaacagtctgttctgctgaatgacagtattctgaaaataacgactccctatatgcgtttttacgaactggaagccctttgtgctcttggcgaacaggatgctgtaatgaaagaaatgaaagcctattggggaggaatgttaaaggaaggcgccacctctttctgggaaaaatacaaccctgaagaaactggaacgcaacatcttgccatgtatggccgtccttatggcaagagtttgtgccatgcttggggagcgagtcctatctacttgttgggcaaatattatctgggagtgaaacctgtaaaagaaggatataaagagtttgctattactcctgtgttgggaggattgaaatggatggaaggcactgtacccacaccgaatggcaatatccatgtctatatgaacagcaaaacgatgaaagtgaaagcaacagaagggaaaggctatctgacaatcaaaagccgtcgttcccccaaagcaaatatcggaacaccggagaaagtgtcggaaggagtatggcggctctggatcgattcacccgaagaaagaattgttacctatcatttataattcatttgttaattagttagtggagtagtccttgattaacgatcctcttttatagtggagattgttaatcagggactttttttataggaatatgcattgccttttctaaattttactacttttgttttgtgaaagacacataattgtaatatgtcttttgttcttttggaaaaacgattaaacaaagtccaaggaatgttagataaatcagctcaatacactaatacggatgacgagaagctcttttccttcatagaaaaaggagataaaggagcctttacacaggcttatgacagatatcataagctgttatatgtattagcttaccgttatttaatgaatgcagacatggcagaagatgtagtgcaacatgtctttgcccgtttatgggaatttaggtcggaactacatgtaggaatcagccttaagaactatctgttcactatgacgaaaaatcatgtcttaaatctgattcgtaatgagaatagtgcaatcagtaagaactatgagatagcacaatcggcacctgtctacgaagataatctgatagaaaatctggagaagaaagaattgatggcttctttttataaagcggtagatatgcttccgccacagaaacgcagtatttgtttgatgaaagtgaaagaggaactaacgaatcaggaaatagccgaacggatgaatctgtctgttaatacagtcaaaacgcattattcggaagcattgaaaatgctacgtattcatttaagtaaaatgctaataattgttacttttgtcacactaatgacgtatttgagtgtccactatttaagataaaaagagaatgaatcgacctactgataaacaaatagaagaagtgcttgccggagttgctacaccggaggatgcaaagtttgtggcggaatggtttgccacagaagaagggaatacttatctggatgctgtgatgattcgggaggcggaatgtttaaatgccgaaacggcagaaatatatgtggaccatattataccttcagaaaagatgtaccaccaaatccaaaagaacatatcacgtaaacagatcaaacgtatctgcttccgtgtggctgcaatcttgattcccgttattttcctggtaggtctttatttacagatcaattcccgggtggatttattcggcactacggaatatgaggaaattcgtgttgccaaaggagagcggatacagatgatgtttcaagacgggacacgagtttatatcaattcggattcctggttgaagtatcctaaaaagttcggattgggtaaacgggaagtttttctggtgggagaagcctatttcgtggtagccaagaataaaaaacgtccgtttattgttaatctgaacggaccttctgttcatgtactgggtacttctttcgatgtacaagcctacccggaaaataaagatattgtgatttgtctggatgaaggacatgtaaatctgactctctcctctgcaaaagaatacccgttactgccgggtgaaaaactgatatataataaagaaagtgagctgtgtcggataatcaaaaacgatcattcaaaacaagtctcaatgtggaaagacaatgtgatttcttttaaagatactccgctgacagaagtagtcaaggttttgaaccgctggtataatgtaaactttaagatagaggatgagcaggcatcgaaatatgtatatacgttgacctcggataatacgatactggagaaagtgcttcaggatttggaaaaaattgcgccggtaaaatttgaatatgatgaagtccggaaagaagtgacagtccgaatgaaacaggacggaaagaagtaaaatatactggataggataatagaatgaggacaggctgtgtatatacgcagcctttactgttttagaataagaatgttatgaaataaattaggcttatgcaaaaaaactcttttttctctcacccgcttttttgacttgtgtgtctactaagcataaatgagattttaaatctaagtttaactttaatcaaagcaagtagtatgaaacacaaagttctgctcgtattgttgctggggataatcataagcgtgtccgcttctgcccaaaaggtgacaatgaatcttaaacaagtaaagctggagaaagtattctctgctattacacagcaaactggtcttacggtggcttatagccgtacgatcgtcaatccggatcgaatagtgacggtagaagcaaagaatcaggaactatccaaagttctgaatgatttgtttctcggtactaacgtgaactatgagatcggaaaaacaaaaatttatttgaaggagaaagttacggattctgaacaacagaccagtaatgcgaacaaaagaaatatatccggtcgggtagtcgatgagaaaggagagccgattattggcgccagtgtgatggtgcaaggcagctctttgggtacaataacgaatgtagacggacgttatactttggctaatgttcccgaaaacagtacgattacagtctcatacatcggatatattacggttaattacgctgctactagcagaaatctgtctcaagtagttcttcgcgaagatagtaagacactggaagaagtggtagtggtgggatatggtacgcaaaagaaagtaaacctgactggtgccgttgctatcgtttcgggtgatgaactgacgacccgttctgctgccaacttatcacagcttctgcaaggttctgtaccgaatatgaacgtaaactttagttcgggacgtcccggacaagggggaagcttcaatatccgtggagtcaactctattagtgcggatgcagcacctctgactatcattgacggaatcgagggagatataaataaggtaaaccccaatgacgtagaatccatcagtgttttgaaggatgcttcggctgctgccgtatatggtgcccgtgctgcttatggagttattttggttacaaccaagaatggaaaggtaggcaagaccaatgtcagctataacggtcgtttcagttttggtgaaacgacaacttctacggattttgagacgcgtggttattattcggccggtatcaatgatatgttctacaaaacataccagggcgtcccttatacacattatacccaagaagattaccatgaattatggattcgccgtaatgataaagtggaagatccttcccgtccatgggtggtagaaaaaaacggagagtataaatattacggcaactttgactggtataattgtttgtttgataatacccgtcccacttgggagcataacttgacggtttcgggaggaaccgaaaaagtgaagtacatgctatcaggcaactactataatcagaaaggaattatcagaatagatccggaccgttttaagaaatatacgttccgttcgaaaatcattgccaatatcacttcctggtttgaattaagtaacaatacttcctattaccattctgaatatacctatccgggactatcaggagtgaatgacgttttcaccagagccgggcggcatgctttggcaagtattgtgccgatgcatccggatggaactctggtttacagaacaggtctgacagacacaggagaagtggcagatggtgtgagtgccgtattattgaatggcggccaccataaccgggatcgtgaatatgagtttgtaactacgttcgaggccgtattgaaacccatcaagcattttgagattcgtgcaaattacagctgggcgcattacaaccagcagaatttgaatcgttccgtagatgtgttatactccagaaatccgggagaaacaatcacaatggataacggacgtaccagaggcaattatttgtcggaaatacaaaacaaccagatacgccagactttcaacttatacgggacgtatgacaataccttcgcaaatgcacattcggtaaaggtcattgtgggaggtaactatgattataagtatttcaagaaactgggaatgaaacgtaacgggttactctctgaatctctcgatgattttaatctggcaaaaggtgatgatatatccataaccggaggacaagaggaatatgcgattcttggttttttctatcgtttgaattatggatataaagaccgctatctatttgaagccagcggacgttatgacggtagttcccgtttccgtcgaggacatcgtttcggtttcttcccgtcgttctctgccggatggcgtgtcagtgaagaagccttctttacacaagccaaaaactatgtaagtaatctgaaactaagactgtcttacggatcattgggaaatcagaaaacagtaggctattatgactatctgcaactgattaataccggagcggtaatgaactatgctttcggagatactacgaaaggcgattatgcctatgagtcagctccgaactctaccgatttgacttgggaaactgtaatcacaaaaaatataggtttggacttgggttttcttaataaccgtttgaatgtatcttttgatgcatatattcgtgataccaaagatatgttgatggcaggaaagactttgcctggcgtatatggtgcctcttctcccagaatgaatgtggcagacttgcgtacgaaagggtgggaagcatctgttacttggggagatagttttactttggcaagcaagcctttcaactaccggataatggctggtatcggagataacacctccaaagtgacaaaatatgataatcccaaccgaacgctgactgatccttacgaaggacagcagttgggcgaaatatggggatacgtagtagacggttattttaaaacggatgaagaagcaaggaattataaagtggaccaatcgttcgttaaccaaatgattaatgcaagcgctttggataatggacttcatgccggtgacctcaaatttgtcgatttggatggtaacaacaagattgaacagacaacatcagctaatgaccggaaagacatgaaagtgatcggtaactcattgccgcgctataattataatttcggaatctctgcagattggtatggaattgatttttcagttctttttcagggcattggcaaacaaaattggtatcctggtgctgaaacgtccatgttttggggaccttattcccgaccatacgctagttttattccttccgactttatgagccaggtatggagtgaagaaaatacaaatgcttatttcccacgtcccagaggatatgtggctctcggtagtaatcgtgaattagcagtggttaatactaaatatttgcagaacttggcttattgccgattgaagaatctttctattggttacacattgccggataaatggctttccaaaataggtttcgagaaaatacgtgtttactttagtggtgagaacttgctgacattcactaagctacattccgattatattgatccggaacaagcatcggcaagtaacagctggaaaacaagtaaaagtgacgcaaatatttatccctgggcaaagacatactcttttggtgtagatataacgttctgataataacgaatataaaggaatatagtatgaagataatgaaatatacattgtgggcgactgttggtctgtcgttgttatttgcttcttgtgaaagcatattggatataaatccgaaagatcgcttgacgactaaggattattttacgaatgaagagcaattacagttgtacagtaaccagttctattcaaacaattttccgggtgacggtgatatttatagggacgatgctgatatgctgattgtatctcctttaagcgacgaagtgagtgggcaacgtgtcattccggaaacgggtggaggatggagttggagtgcactgcgatcaattaattttttattggataatctgggaaactgtaaagaccagaaagtgcgcgacaaatatgaagccctggcacgcttcttccgtgcttatttttattttgaaaaggtgaaacgttttggagatgtaccttggtacgataaagtactcggctcggatgatgctgatttatacaaagccagggattcacgcgaatttgtgatgggaaagataatggaagatcttaattttgccatagaggtttttaaagaaaccaaccggacaaaagaactttatcgtgtaacctggtggactgcccaggcattaaagtcacgtgtaggattatttgaaggtacttatcgtaaatatcatggattgggtgattatgagaaatacttgaatgactgtgtaagtgcctctaatgaaatcatgactgcttccggaggatattcattgtatcaatccggctcacagtcctatcgtaatctctttaaatccgagaatgcgattgatgcggaaatcatattggcaagggattataataatgatttgagtctggttcataaagtacaggcttttgagaattctccgacattaggccgccccggactttcgaaaaaactggtcaattattatttaatgaagaacggcaaccgtttcaccgaccagcccaattatgcaacaatggaattcaaggatgaaatagtcaatcgtgatccgcgtttagcacaaacaatccgtacttcaaatataaatatgaatgtcacgatgaccggataccacttgctgaaatatgcaaatgataatatgagctatacaggtgattcaagcaatgaccttcctctgttcagattggcagaagtttatttgaactatgccgaagcaaaggcagaattaggcacactgacgcaaactgatatcgacaatacgataaacaaattgcggacacgtgcaggagtcacgggaaaactgaatatgaacgcagcaaacctttctccggacccttatatgtgtgctccggaaaccggttatgtgaatgtcacaggagataataaaggggtgattctggaaatccgccgggaacgtgcgatagagctggtcatggaaggcttccgttattatgatttgatgcgctggaaagaggggcaatgtatggcccaatcctttaaaggattttatcttcctgctacagctatcaataaagcgtatgatattgatggagacggaacaaatgatgtctgtttctacaccacatcttcgcaacccaatgtggggagtgtgacgtatgtaaaactggcttctgatggaagtggcacctctttgtcggaaggtaattatggtaatttgttgtgttatagctggatcgaccgtacttggaatgagaaccgtgattatctatatccggtaccaagacaggaaataacactatctgacggtgttgtaacccaaaatccgggatggaatgaataacaagtataaaagatataaataatagatttatgaaaaagatagtaatatatacattgatttccttcatattctctgtttttgccagcagttgtgaagataataaagacaattcattgtactatcctgatttcacgtgggatacaggagatggagaggaagacgaagaccccgtaactgaaacgtccatgcgtgtagcaacttataacttacaggtggagactggtacaggatggactaaccgacgggaacgtgtggcacaattaatcaaagactacgattttgagatttgtggattcgaagaagccagttgggaacaacgttcctacttaggaactcaacttgcgagtgattatcagattctcgcttatggtcgtgacactggaaatgacgataacaaggcaggagagatgagtggcattttatataagaagagccgctacacattactggatgccggacgtttctggttttccgaaactccggacattccttccaacggatgggatgaaacaaatttcaaacgtttctgtgtatggggaaaattcaaggatagtaagactcaaaaagaattttatctttttgaaactcacatgcctttggctgataatgctagaaaacacgcatgccaaatgctggtggatgcagtttccgataaagcaaaagacaatactcccgcattttgtaccggcgactttaatgctactcctgatgctcccgaaatagccactacgatttgccaaagtggtatattaaaagatgcatatcgggaagcggccgttcagcatggagctctctttacatttccttctaaaaagaccagaattgattttatttttgtgaaacatgctacggtgctttctacccgcactattgtcagttctttatccgatcattatcctatggtgatcgtagtagaaatctaaaataaaaatgaagattatgaaaaacaaattttatcatataagtacatactcggtaatgagatattggaccattttatggatggctattttatctttctcatgctctgattttaatccgatggattcctatagccgtattccgccggatagaaacacagacatagatgacggagacgagggtgacggagcaggcgggctttttgaaaaaggttatggaacagtgaacaagccctatctcgttatggatgtgatacagattcagaatatgagtgaggctttggtgaaaggaaagatgatttatttccaattgggagctgatattgatatgaagtctatatctaattgggatccattgaacccaaccggtgactattatatctattttgatggaaataatcatattataaagaatttcacctgtacagacaaagcgtatgccagttttttcggtattttggccgggacttgtaaaaatgtcggtttctataatgcccatgtagaagcagctactaatagtggggcaggggttatcggcggttatatcggagtgaaagctccgaacgctgtagagaagacagggcaggtggaaaactgttacgtctccggaaaagtgaaaggaaagtatgctggtggaatagcttcccgtatgggtagaccgtatggaggacagatttgttatatcaaaaactgttattccacagcagaggttatatctacaggagatgaatgtggaggtattgtaggttctatgtatgaaaacagtgaagtgtcgtattgctattctacaggtgtattaattggagccaattcagtgggaggtattgctgcacttccttccgaaggagctaaaattacgtcctgtgttgcttggaactggaaaataacaggtcctgctgccagatctggacgtatcagtggagttttgtctcaaggtgaaaatggacatcaggcggatcccgtcgcatctgaatgttatgcatgggaggatatgatttgtacaggatttactccggaggataatgcaggttccgtttcgacaggaaaatatgatggagtgagtgaaagtgctctgactttgcagaatagcattgctaattgggggaccccatggcataatgttgggaatatagatatgggattccctattttagagtggcaattggatagagaagattatgctagttatggaggacatgacaacgaaccggaaggagattttgccaatggagacggaactcaaaataatccttatgtgattgctaatgctatccatattcagaatatgagcaaagccctcattgaaaaacaaacgacttattttgtcttgagtgcggatattgatatgcaggggatcaagtgggcacctctaaatgatgctaatggttaccataaatggattgatttcgatggacgcaatcatgtaattaaaaaccttacttgtgagtcaggcacatatagaagcttcttcggggtattgtgtggagaatgtagaaatgtgggatttgtggatgcaaatatctcatctccgaatactggtattggcatcatagccggttatgtaggattggctgccggtgcagagaattatactggaaagataacaaactgctatactaccggagtactgaaggggtcgggagcagcaggtggaattggcggtgtacttggtggttcgggatatatcaaaaattgctattccagtgctactgttattgatcaaattgctaacaatacaggtaaagctggtggaatcatcggaagggtgaatggcaatgccagtggaagcagtattgaaaactgttatactagtggtgatatcaatgccataggtggaggaaatgccggaggtatagtcggcaaagtggatggcggtaaactagtcataaaaaaatgtattgcttggaatagtatgttggttagtaccgataaagcaaaggtgggacgtatagtcggaggtactgccaatgctacttatgaaaactgctatgcttatgacggtatgattttgaaagcaggagaggctacatttaccgtttcagatgagacatcaccgtccggtagtagtttccaaggagtagctaaatctgctaacgagctgaaaaacactgtcataaactgggattcttctctttggaaagaaggaggcaacggctacccggtatttaaatggagtaaataaattgatatttaatgatttgtaatatgaagtgttctataaataagaaatattattttctacttttgattttactttttgccggaggtcttccggcaaaatcttccaacttagacaaaacgaaaccggaagatattattcgccttgcatcttataacatccgtaccaaaggagacaagggggataaggcttgggaagtccgtctgaacgcattggtagatgttgtgcggcggaataagttcgatatgtttgccatacaggaaggacgtacctctcaattaaaagatatgatgattctgaacgaatattcttatatcggtcgtgatcgtgacggggataataaaggagaacattgtgccatttactataaaaaagatcgctttaaggtgttgaaacatggtgatttctggtattcggaaactccggatataccttcttatggttggggagcacgttgtcgccggatttgcacttggggatattttaaagacctccggtccgggaagaaattctatgtatttaattcgcatacggatcatgaagcaacagaagcaagacggcaatcttcgttcatgttgttggaacaggtaaggaaaatcgctaaaggcagaccaaccttttgcaccggtgattttaatgccactccggacgaagaaccggtacaacttctcctgaaagatagtttattactggattcatataaatgtactttgacgcctcctaaaggaccgtccggtagtttttatgcctatgacaaaactggaaaaacagctaagcgcatagattttatttttgtgactccaaaaataaaaatactttcttatcacaccattgatgatgatataaagtataataagtactcttcagatcattttcctgtaatggtggaagcgctactgaaatgagaaaaggaataaacatttgaatagttataaaaaacaagttgtaaaggtcgttcattactataagtgtatagatatatttgtatatatcgcattggtgttgtttcggcctttacactgttttctttttctcatacaagatactaataaactcatagaacgtttataataaaaagtgaaatagtttattataaacgtctcttgtatttattataaacgacattcatagaaattcgtcaaacggcactgaatatattaaacaaaacggggtgaaatttttgctaatttcaccccgtttttactctttcagacatatatttatgtatctgaaaaactactttatgtatctatttttgtatatatcattttgatgttagctaattggttattgcaaatatacaaaataaaaagggcaaagtcaatagttctattcatttagaatccacaaactgcccgaatatattgatcatattaatattgagaaaccaaacatgcggacaactctttttatagtcagtctagtcagcagcgtggtacggatgtgtaaaccagaagcaggagcctactccttcggtcgaatccacgccaatttctcctcccatttgggaaacaatgctcttacagatagaaagtcccagtcctgtaccctgaacaaaagtattcagcttcacaaaacgttcaaatacgctcttttgcttttcttccggtattcccattccggtgtcgcgcacatagaattttattttctgatgggatacttgttcatatcccaaggtgatactgccttgctgtgtgaactttaatgcgttatttataaagttactgattacttgggtgaatctgtttttatccgtatagatataacattccgggaatggttcctccaaaatcagttcaacacctttacccactttcatccccattgatttgataatttcagaacaagtctcattaacatccacattggtatatacaaaattgaatgttcccgcttctattttcgaaagatcgagaatgtccgatatcagttgcaagagaagttcattattctcttgtacaatcttaatgtattcttgccgttcgcttctgctgtccgtttctgccagaaggctggaaaagccgacaatagcattgagaggagtacggatctcatgactcatgttagctaggaaagccgacttcagacgatccagttcttccgctttatcgcgggcaataatcaatttctgttcagtttctttcaaaggcgtgatgtcataattgatacacaacatctcaataatgccgtcttgcggacggtaatccctgaccatcacattgatgctggtccatgtatatttgccattctccctgcatacacgaacttctttacgcaaactggttgcctttcccgttttcacttcacctacaaagtttttcagaacagcctgatcttcaggaactacatgtgcatatactccaataacctgtggcatgggagtaccttctttttcacccaaattcctgtaccatgtatcttgggcatatccgtctcttgtcaatacattgaaatgagcaaatcctaccttggcataatcaccgattagaagaaacagattctcaaactcctgtatcttagtgtatgcattggtcgtttccgttgtatctatattgataaacagatagttgataaatcgattttgagaatcatagagagcagtaaccttagtagtaagattaataatcccatttctccggctatctacatattgatttatttttgagaagtcataattgatggagaagtttacatcttctttcgctctcaatctctctttaacctctaaaggaatattgggattgtcgaacagattaactcccaatgcttcattcttgtcagacaagccgaatatttcaagctctttatcattaatatctaccagataaccgtctttgtcataaagttcgacgcctgccggaaggttcttatagatgtttctcaatatcttctcgctgttgtccaaagcaagacgatcttctttggcttgtaattccgactttcgcaattcgatgcaaatactgataatattagcaagagaggagaagcattgataatccacattgctccagctacgctgcgttcttaccatatcaattcccatatagccccatacctcttctttagagattagcggaactaccatcagcgatttgatatcctgcatttccaatgtctgacgatattccgcagcttcttcgggcatgtcgtccaacgtgttcagaatgatagctcttctttcggctatctgatggttccaccaggtagaagggtcccagggaatattgctcaagaattcctgttccttggatattccttcggcggtaacctcataagtgcaatcctggcgttgttcttttctgtttatttcgaagatatagatacgatcgcccaaaaactggttgaggagatctcctaatgtcttgttaaccacttgagtgacatcatcacattgcagaaaagcaagcaatgaatatgaaatattagtttgttggtaaagcagattgctcacttgaaagaaatcaatgttttcattcgtagtatcgatcggtctgtcaatatattgcagaaagcccgtcatattcctatatccctctttatcgggcttttggaaattaatcttagagtacacccatatttccccgtcttttgcccggattgggaacatttgttcgtatgtctccagataagaaagagacatatattcatttttgagacgcagccggtgatcttcacgtattctttggtgaaattcggtgaaactgatgcggttactttcaaggccgagtaagtcaacaataaagtcagagcagatatattctttatttttcaaatctgactcccaccatcccattttggccatttgtgctatctgaacgtatttttcatagtcataatttgtttgttctttcatattgtttgctcttgttttctgttttatattataagctagccggcaaagataagcataacttttaaataatgaggaatttgcatatcacagcaggatgaaagtggaaatttggtgctgaaaagtggaaaaagagacaaatgagtacaaacaggggattatttcgtctttctcttagtgaagaagtgaattatataatctataatatatatcagaagaatgaaaaataccagattattcatgtttgcggcatgcacactttttttggcagcgtgtggcaggcaaaccgtgaagattatgactccgccggatgcgtcaaatcgtgttttgtttggtgcggagcagttacagactaccttggataaagccggttatcaggtaatgatgcaacagggagacacgacattctccgatcccgaaatcaaaacgattctcttgacggaagtaaatgacacgacgctcaagaaagaaggttttcatatttcgacgacgggcaatctgaccagagtgtccggcagggatgggagtggtgtcatttacggatgccgtgaactgattgaccgtgtgaatgattcggatggtaagttgaacttcccggaggaactgaaagacggtcctgaaatggtattgcgtggtgcatgtgtaggattacagaagatgacctacctgccgggacatggtgtatacgaatatccgtatacgccggaaagtttcccctggttttatgataaagaacagttgattaaatacttggatatgctggttgccaaccgcatgaattcactgtacctttggaacggtcatccgtttgcgtcattggtgaaactggaagattatccgtttgcattagaagtagatgaagaaacgttcaaaatgaacgaagaaatgttctctttcctcacagaagaagcggacaaacgcggtatctttgtcatacagatgttttataatatcattctttccaaaccttttgctgaacattacggactgaaaacacaggaccgtaaccgtcccattactcctctgattgccgattatacacgcaagagtattgccgctttcattgaaaagtatcccaatgtaggattactggtttgtctgggtgaagcgatgtgtacagtggaggacgatgtggaatggtttaccaaaacaataattccgggagtgaaagacggattacaggcattgggacgtacggatgaaccgcctcttttgttgcgtgcgcacgacacggactgcaaactggtgatggacgctgccttgccgctctataagaatctttatacgatgcataagtacaatggtgaatcgttgactacctacgaacctcgtggcccttggtcgaaaattcatacggatttgagttcgttgggttccattcatatcagtaacgtacatatcctggcaaatttggaaccgttccgctggggttctccggatttcgtacaaaaggcggtcactgccatgcacaatgtacacggtgccaatgcgttgcacctttatccgcaggcctcatattgggactggccttatacggcggacaaattaccaaacaatgaacgtgaattccagttggatcgcgattggatctggtatcagacctggggacgctatgcgtggaactgccatcgcgaccgtacagatgaaatgggttactgggaccatcagttgggcaagttctacggaacctctgacgaaaacgcaagtaatatccgtgtagcatacgaagaaagcggggaaattgctccgaagttgttacgtcgttttggtattacagagggaaatcgccaaacgttattactgggtatgtttatgagtcagcttgtcaatccgtacaaatatacgatctatccgggattctatgaaagctgcggaccggaaggagagaagctgatagagtatgtagaaaaagaatggaaaaagcaacctcatgtaggtgaaatgcctttggatattgttgctcaagtaatagaacatggagataaagcagtagcggctattgataaagcagcaggttccgtctcttcaaataaggatgaatttgcacgtttgcagaatgatatgcattgttatcgtgagtttgcgtatgcgttcaacctgaaagtgaaagctgccaaactggtattggattatcaatggggaaaagagattaagaatcttgaagaagctattcctttgatggaacaaagcttggaacactatcgcaaattggtggaactgacggacgaacattacttgtacgccaacagtatgcaaactgcccaacgtcgtattcctatcggtggagatgatggaaagaataagacttggaaagaactgctggtacactatgagaaggaattggagaatttcaaagccaacctcgctttgttgaaagaaaaacagaatggaaatgcggtgactgaaactgtcgagattgctgcctggactcctgcaaacgtgaaactgatctctaattatccgacagtgaaagtagatgagggtatttctttatttgtggatgttccaggtaagatagaagcaatagctccggaattgaaaggaatgaaagcgctccgcttcaatggaaatgagcagagagagaaaggcacaagcatcactttcgaaacggatgctccggtgaaattgttagtcgcttatttcaaagacgaccagaaaaaatatgcaaaagctccgaaactggaaatcgatgcgtcagccaatgattacggtcaggcggaacccgtgttgacgaatgctgtccgtatcaatggaatgcctttggcaaatgtgcatgcatatagttttccggctggaaagcatacgttgatgttacccaaaggttatctgcaagtgttaggattcacggctgcggaaacgaaagtgcgtaatgccgggcttgccggggatgaagagacaatggattggttgttttattaatgagaatttatcggttaaatgagaatttatcggttaggctgaaagccttacaattatatatttattggagtgccctgaaagggcttaattatatagcgtagggtaacaccctacgaaaaaaacacaccagccacaagccctgaaagggcggaactgtatacaattatgccctttcagctatgtttctaattataagtgaaatatatttattcttatttcgaactcacgttaaatagtattcaatagtctcctattatgtttttattgtattcctgcttatgagataactgtttctaaccttgaagcttacgcttccaaagtagtttcaaggttgaagaactttagtttcaggcctttgaaaccatagtttcaagtaagtgaaactagagtttctcaccgatgaaactaaagtttcccactgacgaaacagaagtttcaagcaatagaacttttagtttcaagtactgaaactctctcttctgtaatagtctgataatccttgaataccgctccggatagagaaataagtacccacatagcagagaaacaataaaatccttgctttcaacaaagtgacagcaaagttgtcgtcaccttgccgtcacatcatgctgtcacactgcagtatatttataatcaatcatttatgcccaatcaggtgacagatgacagcattttatttattttccaatttatatgtagggagtatatgactcctaaaaaataaatgacccatataatatgaacaatatgaaatcaacttttttattcctacttactacaaccatgatgacctgtactgcctacggacagtcttccaatcataaagagaacaaattacccgattgggctttcggtggttttgaacgtccaaagaatgtcaatccggtaatatctcctatagaaaacaccaagttttactgtccattgaccaaagattctattgcgtgggaatcgaacgatacattcaatccggctgctacactctacaatggtgagattgtcgtgttataccgtgcagaggataaatcaggtgtcggtatcggacaccggacttcccgcctcggttatgccacttctaccgacggcacacatttccaacgggaaaagactcctgtattctatccggataatgattcacaaaaagagttggaatggcccggcggctgcgaagacccacgaattgccgtaaccgatgacggattatatgtaatgatgtacacccaatggaatcgccatgtacctcgcctggcagtagcgacctcccgcaacctaaaagactggacaaaacacggtcctgcttttgccaaagcatttgatggaaagttcttcaacctgggttgtaagtccggctctatcctgaccgaagttgttaaagggaaacaggttatcaagaaagtcaacgggaaatactttatgtactggggagaggagcatgtattcgcagctacttccgatgacttaatccactggacaccgattgtcaacattgacggctccctaaaaaagctgttttctccccgtgacggctacttcgacagccatctcaccgaatgtgggcctccagctatctacactccgaaaggaattgtccttctttataatggtaagaaccattcaggaagaggtgacaaacgctataccgccaatgtctatgctgccggacaagcactcttcgacgccaatgatcctacccgctttatcacccgtctcgatgaaccgttcttccgtccgatggatagctttgaaaagagtgggcaatatgtggatggaaccgtatttatagaaggaatggtctacttcaaaaacaaatggtatttgtattatggttgtgctgactccaaagtaggagtagccgtttatgatccgaaacgaccggcaaaagctgatccgcttccatagttataaaaatagtcttgattacattcttttttaaaggaaagatgtaatcaggactaacttatttcttaaaactatattccccaaaacggctgaaaacagtaagttcttgttaaggatttgcttttcagccgtttctagtataaaataaagctttccgaagcagaattaaatgctacaatcggaaagccttataatacctattgaaaactgaattgaatattgagaaccagctttattctttcattgtcggaggcttcttcctcctttcaacaattagctgtcttttataagtaagccatctttatccatttatcttattcaaaacaaccggtctgtttgccggagccttaccaaaattcttattaggctttttccccattacaaacttcaatgtgctgccatttattatatcctgataagtgatataactcttatcataaggcttgccattcaaatacactttctggatatagatattttctttgctgttattgggtgcttctacagtaaaagtgttaccaccacgtaccttcacttctactttcttaaaacaagggctaccgaaaacaaatacaccatccgacgggttcacctgatagagtcccatagatgaaagaagataccaggcagacatttggccacaatcctcattaccgatgataccgtccggctggtctgtgtaaaaatcgctcatgataaaacgaaccttttccgccgttttccattgttcaccggcatacgcgtaaagataagcaacatgatggctcggttcatttccatgtgcatattgtccgatcaatccggttatgtcgctcgatgctccttcccccatactgtcggtattggtaaagaaaccatcaagcttcgttgtaaaaggtttgtcacctccaaacaaggcaatcagcccataggggtcttgtggagcaaagaaagtatattgccatccgtttccttcacagaaatctccaacagtatggatggaacgtgccggatcgtaaggagtacgccaagagccgtcttccagtttcggacgaatgaaatggatagaagaatcaaaatagttcttgtaataatgagcacgttttgagaatgtttcagcatcttctgtctttcccatcttacgtgccatagcggcaattccccagtcgtccactgcatactccatggctatggaagtagcttcatgaactttgtcggcagggatatagccttttttgactacataaggtactcctttctgcttttcataagtagctgtagctatcattgcttgcaatgcttcttccgcatcgaacccggtaaatcctttcagatatgcatcggcaatcaccggcacggagctataccccggcatctgatcggtctctccactcatcaaaggccagatagggagtttgtcctgctgacgatagatggaaatcatcgaattgactacatggtcaaccatttcaggttgagtaatagtcatcaaaggatttaatgcacggtaggtatcccataaagaaagagtcgtatagttgactttcttcgggtctgtgtaaatcatgtcattcatccctctatactctccattcacatcgcaaaaaagcgtaggggcaatcatagtatgataatgggcggtatagaatacacgtttggaagcctcatcatcagtctctactgtcatcttctccagttgcttattccatcggtcggcactcatatccaccaccttatcaaaatcccagtgagtaagttcggattgcaagttcatcgctgcgttgtcacagctgacagaagaaagggcgacttttatcttcacttccttcacgttaccaaaagtgaggacactcttcaccgatgccactttcagttggtcccaaggttgcggggtattatcatcataggcagtaaactgctctatcttcttatcacttttcaacacaaaataaactttgcgggaaggactccagcctctcacataacgataaccctctactgtataatcatctaccttacggatatagctgtcgtaagcattcgatccgtttccttcacgtaagtcgattaatatggaagccggttttccttcaggataagtataacgatggaagcctacacgatctgtagctgtcagctcggctttgatattgtaacggtcgagaagcaaagagtaatattcgggacgggcgatttcattcgcatgagaatatctggaagcatacccatcacgtatatcatcctgattgcctctggaagtacggatctcattcaatggcatgatgagaatatcacataagtcagtacagcccgtaccgctcaaatgggtatgtgaaaagccaattaaaatactatcggaataatgataacccgagcaccagtcccaacctttatggatattagtaggacccagctgtaccattccatacggaacactcgtcccaacaaagacgtgtccatgataaccggatccgatatacggatcgacgtactgcaataatccttcactttttgaatagttctgttgcgctactccatttcccgctgcaagcaagacacaagaagtaagtgcaagtagtttaaatgccttcattcgtatttttctttggtatgattgaaaattatagttagcgaatgatgcaaatatactacctatttaggaattaactaactgtcgctagagtttacaagaaaaatggcaggcaggtttactcttttggcaagttccaaccacagatttacacggttttccacagaaaaactgcgtaccgtctactaaataacataataaatgaatctgtggaaatccgtgttaatctatggcgaatcctttccataaattcccttcgggaagaggagcttcaagctctatcagttcttttgagacaggatgtatgaaccgtactctccgggcatgcagacaaatgctcccatccggattggagcgtggagagccatatttcaaatctcccttgatagggcatcccatttttgccagctgacaacgaatctgatgatgacgtccggtttttaaatcgacttcgagcaaatagtaattctccgaatgaccgatcaaccggtaatgcaagatcgctttcttgctgttcggcacttctttgtcgtatgcataacttttgttctgcttttcattacgtacaagaaaatgtaccagttcaccttccggttcttgcggagcatttttcacaaccgcccaataagtctttttcacctcactggtgcgaaacatttcgttgagccttgttaatgccttactcgttttggcaaaaataacaagaccgcttacggggcggtccagccggtgtgtcacaccgaggaaaacatttccgggtttctgatacttctctttcagatactgtttcacagtctccgaaagcggcgtatcccccgtcttgtctgcctggacaatctcggaagcggtcttgttgactacaatgatatggttgtcttcgtatacaacagtcattctgttcgattacatattcataccaccatctacctgaatcacctgacctgatacataagaagacatatcagaagccaggaaggtagcgatgtttgccacatcttcaggagtaccaccacgacgcaaaggaattttctttgcccattcagctcttacttcgtcagaaagagcagctgtcatgtctgtcaggatgaatcccggagcgatagcgttggcacggatgccgcgagagcccaactcttgtgcgatagacttagccaatgcaatcatacctgctttggaagcagcatagttagcctgtcctgcatttccgtgaacacctacaacagaggccatattgataatgctaccagctttttgacgcatcatgataggtgtacaagcatggatgaagttaaatgcagacttcaggttcacgttgattaccatatcccattgctgttcgctcatgcgcatcatcaaaccgtcacgagtgataccggcattgtttaccaatatatcgatccgtccgaagtccttgtggatttcttcaacgacctttgcagtatcttcaaagttagcagcgttagaagcataacctttggctttcacgcccattgcttcaagttcctttgctgtattttctgcattttcgtcaatgacaaggtcagtaaatgcgatgtttgcaccttcggcagcaaacttaagagcgatagccttaccaataccgcgagcagcaccggtcacaatggctgtttttccgtctaataatcccatactaaaagttatttaattaaatttctgttctatgcagtgcgccaaacacaatgttggacacatatctatttctcgtatcttcatccagatgtgcacctatatggccacgaatgtaaggaacttcaattcctttcacacaataatgtatcaagtcggcagtcatctccacatcgtcaatatggaaaactccttttgcctgtccttctagaagaacagctttaaagagctggacttcctttgcatcaaacttcttgcgaactttttccacccgccatatatcacggaagaaataagcacgcaatgttccgtttcgatagaccacttcttttaccgcgtccaaccgggtatatatcatctccaacaatttctcgtccggtgagatatttttctcggccacccgcttcatcatatccgacagaatatccaattccgattccacaacagccaaataaatttcatccttacttttaaaataagtatagagcgttcgtctaccttttttagaagcaagagcgatatcattcatagttgtgttttctactcccatcttcgcaaaaagctgacgggctacatctactaatttggcttttgtcttggatacggtcataggttacaaattgcacattgctgaatattttgagcaaaagtaattcttttctttagaccatacaagaaaatagagagaatattaacatttgtatattaataggtgctaagaaaaagtttcatcattatttcattcattctcaaccaaataagaaaaaagtgatgatttattcgaaaaatattcggctaattatttgtttgtttcaaaaaaagccgtacctttgcacccgttaaacatcgcggagtggagcagttggtagctcgttgggctcataacccaaaggtcattcgttcgagtcggatctccgcaactaaagataagaagaatcgcagaaatgcggttcttcttttttatgacgactcttctttactgactttattcacaacctaatttcagttatcaacaaggatatcaacaaagttatcaacaggttaatttgcttataataaagcaattaactatatagattccttttctatcaacaaggcagtatttagttattcaccatacaaaagccggctgatccctcatgaatcagccggcttttatgttccttcgaaaaagggtatcctattgatgtttataaaacttcagtatctttttcgcataacgttttcctaataacagttgtgcttccgtattaaaatgagggtctttctcatctttataccatcccaatcctttcgatgatacccaatcggaatagggaataaatgaagaaacttttttaatcatctgattaaaggggactgtacctgcttctcttttcgtccagttccattgagaaatctgtcctacaacaaccggtagattcggcatgcccagatcttcccgcaagtctttcaccaaagaaatcagtttctgtttatacgcttccggattcgaacaatcggcttctccctgatgccaaaggattgctttcaaaacacctccctgcttcattgcaatccgaacccgggaaagagcttcttcataatatccgtctttactcccttttagccaggagttgatggatgagcctccacgcgcatttactaccagtccgacaggacgtttcgtttgtcgggccatctctttagcaaagccgtaagccggtcccaaacgctgcattgacaaatctttccgaactgtagaataacgattgagaggatttactgccggttcaaaattccccttatcattcaatagatacacattttggagggtatccatgacttccggagttaatgttgcacgccccgccatgttggattgtccgatgcatacatacaagtcaaaagaagacggaacattctcctttacattcccggcaaaagcaaataaagattgcaggaggagaaaagacagtaaataaatagacctaagcatattgacagtgtttatgattaatagtttctataaatacggatagcgttcagaataggttctccttcttttttatgaaagtcaacactcaatccttttccatccttcaccgttactacaaatttcttgataacagcacgggcatatccgtaatcacgagctatgttgaaatcatccaaaacagtcgttccattcattgaaattccgaagctacggtttccggcaaacgtctgttccgagtcagctcccagattataaaccaacgcttcccgctctttgtccgactccaattctgcccagtacaaatatacggaatattctccattcggtacatcagctttaaaagattttattccaacacgttgagtctggaagattggattcatatccgttcccagaatgtcaatatccgaaccaagcatactgccgaatcctgttttacgacgataagaagttccgcctacaaatccccagctaccgggcttatactcctgctcgggaatccatgctacatttgctgtacggtcttcaaaatatctcggagaacccaacattacatttatttccgtaaatggaattgcttcgtctttcaactgtgagcctaccaactggaactgaatccggagcatatcccgcaatttgctatcaccagccacagcaaccgcttccaggagattctccccaccaacgaacggtacatcgaacaaagcataattatcttccacctttttctttcccagactcttattgttcacaaacagctctacttcttccgcattggagaatacaggaacagactgaatacattctttctgtgcagtattcaccactcccccacggcttttccactcccgattacctataacaagtatcggacgacgtgacaaagctgtcttataaaaccaataaacatccttcttctccctgtttaatccgacaactcctttattgtttacatgaggaacagcatcgacacgggattcggaataaaaatcattcagattccacagactggaaccggcaataaacggacgtttcatcatttcacggagataatgtttatgatacaccaaaccatattcctgtgagaagtcgaaacgttccggctggtaggaatgaagtcccggatctactcccggtccatattccgtaaccatcagtacttttcctttgtataccttatgagcacgatcaagcaaacgttgaaactcattaatatccggttcataccagccctgatacaggttccatccctgaatcatcgggatttcggtcagatgggcgtcttcgtaatattgaggcatattatgataagccatcatggtatatcttgaaggatcttcctcgcggatggtcgcttccaaggcacgggctactttttcagtaaagcggtagtaatcttccaattgcttgccttcggtataagggcgacgcagaaaaatctcattcatatacccccaaatcataacagaaggacggttgaaatcctgacgtaccatttctttagccatctcaacggagttctgcaaaaactcttcagtttccgtaacagcattgacaacggggatttcaaccgaagtcacaatacccagtttatcacacatttccatgattacaggatcttggggataatgtgacacacgcaggaagttccctcccatctctttcaacagtagtacatcctgtacatgcaactcgtcgcgcaaggcatttcctttctgaaaataatcctgatgccgggcagttccgattagtttacgtcctttgccattcaggaaaaagcccttttccgaatcaaatttaaaccagcgcaagcctaacggattcaccacttcatccagcaaagtaccctttttcttatcgagaatacgcgtatataccatataccgataaggatcgtctatatcccacaaacggggcgaatctatttttatctttttagagatgtctgtctttgtttcaccggatgccagctttatttccgcatgagtctttttcacttccttaccatccgcatcgcagattacattttccaccctgatttctgcaggttggagtgtattattcgtcagtaatgtagtaatttctaccgaggctgcggagttgttcacttcgggtgtacggatataaactcctgacgaagcataatcattcgttgcaatgtgcaccggattcataaactgcagatagacatcccggtagataccgccaaagaaagtaaaatcggcagataagggaggaatattcggattatagacattgttcacataaatggtaaacaggttttcctgtccataacgcaaatgggaagtgatgtcaaaacagaaacgggtataccctcctttgtgttctcccacgaactgaccgttcagatagaatcgtacttcctgattggctccttcaaaatagatcactgcctgacgtccctcctggcttttatctacaaacaattgtttccggtaccaagccggtccccgataaaatcccggagtttcgtcgtctgcatctttattattccatgtatgaggtatattgaccgtctcccaagaagagtcgtcacagccggccagctgcgcttcaaacggagatccttttgtaaatttccatccgtcgttgattgtgtataccacacgctgttgcgcctgtgcccatcccacaataaacaatagaataaaaatatagagaaacttcttcataatcgatatatacttataattaaaactttattttcacttctctacctgtgtagacgcactctttgctatcaagagctgcaccttcaggcagatataatttcacatgcatttttatttgttccggcataccgggataagttccctcacgcagtccaatagtcaatgtccgttccgaatctttccattgcatcggcactttcgaacatacgccctcttcatagcggtaggaatcaccttcatcctcataccataaaaaagcagcatccgctcctccatagatacgcaattccagttcacgatcgggatattccatcgcatattgtttcacttctgccaaaggcaagatagaaccagccttcacatagagcggaagtatgtcgaggatatttgtctgcatttgttctcttcctccttcaaaagcttctccggtccagaagtcataccaatatttaccgctgtgttccggcagataaatacagatgttcttttcttccgattgcggatgaaataccggacgcaccaataaggaagtaccgaacatataggcattatcaatatcaaatgtccgggtatctgttgtgaaatccattgccaaacctctcaacatggtataattattggcggttacctgatgggacattgagtaaatgtatggcaacagacggtagcgcagatggatatacttcacttgattatcataagataatgtcccctcttcaccgaattgccaaatttcacgcggcacattcgtaccgtgagcacggaagataggagtaaatgcgctaaactggaaccaacgggaatataactctttataatcattacttttcagtccgtcgggatattttgcatcccgttctgtgacaaagaatcctcccgtatcggaagtccaatacggaataccggacatagacaaatttaagccggcaaccagttgtttgtgcatattctcccatgaagccgaaacgtcacccgaccatacggctgtaccataatgctgttgcgaggcaaaggcggaacgagttaggataaatatacgcttctgatcgctctcggcgcgcaggcgttgatagaagtcctttagcatttctaaagaataagtgttcagataacggtggaagctacccagataagtattaccagctgatttggtcttttcttcctgcttcaactgtgtgaatccatcccggaaagatggttccgttgcatccatccaccaagcatccacacccatatcatagagtcctttcttgaggtattgccagaaaatatccctcgcggcaggattgtaggcatcaaaaaccttataacctgcccatgtaggttcactaaacaatgcaccgatagaatccaaagactgatagacagccgtttccggtccgaatccgggccatacggaaagcataaaatgaacatggtcctgttgatgcagttcatcaataacttgacggggatgattaaagtttgccggatggaaggtcaggctgttccaatgaggtttgtctccccaatattcccagtcctgcacaatgttatccaacggaattccccgtttacggtattctttaacgactgccttcaattcatcgaacgacttatatcgttctttggactgccagaagccatacacccattttccaaacatcggcacgtcccccgtcaattcccgataaccggcaacgacttcgtccatattcttgccatagacaaaataatagtcggaggcatcacctacttcggaagtaaatgagtagccctccttcgtatcttcaaacttcgtagaagaataattatcccataagacaccatatccgttggtcgaaataaggaacggattgacaatatccatattggcctgtaacagaagtacggatttcccccggtagttcatgattccattctgatactgtcccagtccgtaaatggcctcatcctcggtaggaacaaagcattgagtgacttcgagacattgttcacctccggcaaccgaacgtttgaagttccgtgcctttctatcccctttctcttttagtaataacttacctgtggatgtttcctgaaaaatgaaagccgcatctgccttatcaaaaactacggaaagttcacgggtgcgaaagagcagcttctgtcccgtatcttcccatttataatctttgaaagccggcttttccgaatcaaccaccaatctttttgttaccagcgtatcaccttcgggaaaagacagaatccgcacgcaccccgccgacataaactcgacccgatattgaatactgtcagatacgaaagcacatcccctgtcatcttcatggaccggagaggaacatccgaagcaggatagtacagataaaactaataaccaattatttaaactcttcatccatgcatttatttgactgtgtagatcgtatagcccaatgacaaattacggactacgacatttccttttaaatagaaagtaggcatattgaatccattcacgatattatccttatacaattctacttttgcgcttttccattcacccgtgttgtcggtacgtatccgggacacaattttaaacggttctttcggttcacgcagcgtagacgaacgtataaaaagggattcatttcctttgtccaaatactcaaaataaagatagcctacatagttattcatttgtagtttggaaaccagctcttttggcaaagaaatagagagggtttcttcggcactgtaaccaccggattttcgctttccctgaatcttcatgtccgactcacgcaaacgcatcatctcaaccgccaaagcggattttgccgtcttgacatcattttctatttgtgacaacaagcctattgccaccggataacgtccctggctaatcaacaatgctgccttatcgagcgaacgttgacaagcggatacgtccatcttcgtcttttccaggaaacgggcttcttttcgcagccggaaaagcattaaaggtaaggttaatccacgctcgtccgcctgttcgtctttgaattccgccgcatactttaaagtcgtacgtagttcacggtcaccgttttcaatggtcggctctatttcgtgtccttcggtatagtcactccacgaagcgataaacatcatgtccaggctgtccttctctgccatacagaacttccacatactttgataagtttctccattgttacgtgggatataatagaagtgtccacgtccccagcccgcacatccccggttatccattcccggcatggcaaatcccgacttaatggtataagcaggattgttactatgccaaattgaatcacggaaaggtttcataaactcgataacatcatcctgagtggcgtaattatcccattcggcatgtgcctgatctcttgtacggacacgggcaggaagccatgcagtcggtatttctcccacttctttccaggtatccatttcatcgctacgagtgacggggatatatttatcattttccagttttccccaatctgcccaacggcgtaaagcaaccggttgcttcattccttgcggtaatttcgccaatgataatactttcttatattcatccactttcgctccgggaccgaaatgataaaaaacaggcattcccttcaccataggagctgtaggaccggtaaagacgctatccaccagatattggtaacatttggccatgtattcggtctttgcctcacgggtattgatttccggataaagtttagtaatccagtcataatacaaccaaccgtcgcaccagtttacgccgatttcaaagtcatactttgctgccactttctgcatctcacgcagcaagatgtcattttcgtgaggcttgaacccccattcgataaagaatccatctatcttagccgcttttgccgacaatatctgatattcgatataatcgggatcgagattggactgcattccgacttggggataagccactgccgctatctcatgccgcccttcactatctatcagatcggcattataacacagcgacttccttccggtacttgatttttccgtattggcatacatttcccaacggcccaactttccgtcatgctgccgggtgtaacgtacaccgtggaagtcggcatacactttctttccattctgcgccaaggccggtaatgcgatagataccaataaaaaaagaagaagtttcctcattgttccaaacttaattattcaacttatgtacttaatcaatcttccaccatacttaatcagtcctcactcaacacgaaatcatgcttttccggataactgaaaagattgtctatcatccaacggcctttataaatcttggctccgtccattttgaaaagttcttctcccttctcatttacaagtccttctgcccaccactcttcagtcggtttcaacatcaggattccatccggtccgttgcagatactttttatatcggctatgctgtaaactttctcgcaagtaggttcggtagagtcattagtcgtagcgtcggtaactccagtcaaatcaaacttatagacagccgaagcagcagtaagccataatttatcttcttcaccatataccgggaacaaatcatgcccacccgattcattgctgaatgtataaagggtagtctgatttattaacttgggattactccggttgccatcgtacttaaaacggaataatgcagtcactccctcttttttggtagctgtagcataaagatacgatcttttcttatcccaaacaacattatgcgcattacccaacttcaccgtattagcttttgctcccaataccttaaccgtgtcaaccacaaaggtattgatttcaccggatttagattctgccgtcacgatatttccatcgggcaatacctccgcagagtggggattctgtccacaatttgcatagaacattaatttatgatcggacaaacggattaaagccacagctccgccggaggcagtcatcaagatatagcgtctattgaaaaccggttttacttcactcggattaacaaaccaaccctgctgtgcagcaggaacacaggcagtataaggatcccaactccaaatattgcggtgcgtctccgcatctctgatgacaatagcccgtctggattgttccgccagtacataagccttttccggaagttgaaagatttcattttttactacaggagcggcatcatcatcggaacatgctcccaaagctatattaaatcctaaaaggattgcaaataaactaaacttcttcatggtcataactattttaattctaaatattcaatttgtctatttaaagtttccgtcaatctattgaaccgattttgtatcgtaataatcgatcaatgaatgaactgaaagattcaactgccgcatctgcgacagaaaagattcataaggttcgtattcgatggaaaccactcctttattagaagcttttccgttagaatcgtaaccatcattatactcaaaatgtacccagcccacacagttacgagtttcaagcaaacgaagacagaagttctgataaaactcacctctatttttttgtgtatgcaccagccagccacctccttcagtattagcatatccagttccctgataactggcatcttccgcttttatatagaattctgaaactaaaaaaggtttcgctccacaccagattttcaggtttgccaagaaatctgcctccggttgccaacgtgcataatagttgacggaaacaagatcgcaataacgagcacacgcttccaccactttctgattatatttactccaatcatgcagacgtgttcccaatatcaaatgctctttatcatatcgcctgacggtagcggtggtcaactgataataataatcagcaaccatcccccggaagtcttcctgatttttcttggttatcactccggtagaagctataccgttatcccgcataaacttttctgcatactcacgagcagctttatagcgttcgggcaaagacaagaaatgtttcagatcaattcctcgcaaagggtcagcattctgataactggcaaatggcaactcattgtcaagatagaaacctataaaatgccggtcaccggcaaataaagctgacttctcttgtacaagacgatctatgtacgtagcaaatgtgggttcaaaaagaagaactaagcgattatatttgtcatcatcaaacgcgtagcccaaattcttactcatatcccacataaaggtacgaagcagatacagattctctgcataagcaatcttttgcgtcttaggggtcaacaagttaccacgtactgcagcaggaaatacttcaatacggttcgagccatacgaaatatagtttatatgattgcctgctaacagtttgccagtctcttcactccattgcgcctcactaccgtatcgagtaccgaaagccttcttatgagcagtagattctcccggacgaacatgctgaattccatgaatgataacagctccattatccggatcgagcaaataagaacggcctccacaataagccactcggaaaaagctttcttttccaaccacagatgaaggttgcaaaccgattcgtcctccccatgcagtccggctataacccgaagagggagtatgccaattcatattatcaatggtacgtgtttcccttgaatctgccgttgtccatgcctggaaagttccgttctgccacttccggtattctacattcataaaagtatattcatctttttccaaaggagtatcttctccttccggtttcaaaggttctatttcgttggaagaggaggaacagctaaacgtcaactgcatcagtccgaccaaagataaaaagaggaaatacctatatattatatgttttctcatattactttcagctactgcacattattacttaaccatcgtatttgttatcagtcgcatctttcgtatactctatctacggttcaccggatagctgttactaactctcgcgttggctattaatagaaaagttattctctacaaggagagaactcccttcccccttgttgcaaacttcttttatccctattataaactataaacgaaagctttgtttttataattgaaagctttgtttttataaacgcaacttgcatttataaaaacggaagcttcgtttatagtttgtatcggacagagaacaactttattcccaatgaaagggaagtttagtcttaatagaaaaaaagttttctattaagacttcagacggtaggtaatactaccctgtttacttcttcttagggaatttgatttcaaccgttaatacacgagctgttgtatctccgggcttcaacacaccttccccggtagacggtgtcatactgataattctcattactccgatcctatttccacctgctgcagaagtcgatgcagttttaaaggcaataatatctccctccgctataggaatcaagtcttctttcacaatcaagctggctgatatttcagaagcaatagaagtaactgttgcattatcataatcaaagtcggagagtttggctaacgtagtcctattctttactgccgcagtgttcagacctgcaccattagaacctttatactcatcagatttcgctgcatttatagaatacagacgaggctctgaaggaacgtccttaccttttcccatacaatagaatttcaaatcaacattcttcgcattgtctgcgctggttaatgcataatcaatagaataagttttcaaatctttgaaagataacaagccataagcatccggatatttttcgtgcgcactattagcaaaagtcttactggatatattcacagtagcaacgtccatatttacatatgctttcacagttccgacagcttcttttcctactctcccatcagaaaccaccactttaatttgagacgtagtttcagtaaaatcaatttccggagtgtaatccaattgtttctcaccattcttctgttcccgtaagacttcgatttcctgtccgttttcaatacggtaaataatcacttcgtgaactccacgtacagattccacctttaccggcactccttgtttagcatccgttgtagcaaaaataggcaattcaggcaaggtcaatacaggtattggcactgttctatattccactggtaaagttgaaatggtcacattatcatatatatccactgcttttactttgaaacctttatcgccttctttgtaattaatcatctcatcatacgagaaatccttcttcccattcagttccacgcttcctttcgattcctgtccggtcgcagataccaaatagacctccactaccttcaaaccggcttctgaaacaacttcgaaagtagtacggggaattaccgggttttcatccatttcatcatatataatctcttccgggtcgaatgttatgacaggacgtgccattacatcggtaacagcaattggtaaagttccgctcgtaacatgattcaatttatccgtagcctcaatgataaaggcttcgtaatttgcattgtattccagattttcagacaagctgtaagaattgggattaaaaaattcagtcaccgttttatattcggtcaccccctccactgtctgcaatttcattgtcacactctgtagtccggcctgcgactttatgacagccactaccggcagattatctactttatttaaatccacatccagttgttccatcgggaatttaatcacaggagcagccgcattaggatccagaccatcattatcatcgctacaggcagcaaagcccaggcaaagtcctagtattaataaggtatatattttacgaatcataattagttctctttttaattaactgtggttatttggaatatttgcaatagttctcaaatatatgaatcacaccgttcgtcggcagaatgttgctagtcttagcctgacgctgtggagatttcccgttgcttccggtctgattcaccagaatcttacctactgcagcctgccatgggtttttccatacagacattgtcatcagtccattctctcctttcagcatcgtcaatacgaacatcggttccacctgcaactgtccataagaactatattcaccgtctacaatgtgataaagcaacatgttcgttactttctctttatcacaatcggtaatggatgctgcacctgcaaattcattttcacgatacaactgcatacctgcattattcaaagccagaaaagtatatttattgtcagtctgggtataatagtccttcagacctgtatactcaatagctgctatcaactccgagaacatatctttgtgatcttggaaatattcccacgctgtcacttttacatacggatcatccaccgaaggctcataatcataattcttctgcaagtccaggtcacagccggtcaatgccaatatcgcccaacaaaagaaaagggtcttatataatattgtctttttcattgtttctaccttttttagttgttagtattaccataatacgtgttctgcacaatcttcggattttccaagatatgtgaatagtgaatcgggaagagttcgtttccgtcctgttccattccgttaatcggtttcatcacttccttccactttccggtacgcaacaagtcaaaccagcggcgtccttcgccggctaattccacttgccgttcacgcaatatataattaacgacttcgtcttcagaagcaaaatcattttcagtcaacgtgttcaatccggcacggtcacgtacagtttttactaaatccaaagcttcaccccattttccctgatgagcacgagcttctgcttgcaacaacatcatatctgtgtaacgataaattggataggctacttcgcatgtcttattcaaagagttactgatgtcacctgccatatatttacgcaattcatttccattctggtaattcttcaccgtataatctttgcgcaaatcacctttcatatccttttcatcaaagatgctcataaacttgtcggacataactgccgcacggtttcctgaaccggaaaaccattgatacatataactgtaaccattcgtgccgacttcatccatgttgaaatgaacaaggaatattaactctctggagttatattcatcattttcgggcgtatcatccgaaggcttattgttcagttcttctgtaaacatggtatgccaagtagcaatgttaggttcgaagtctacaaagcgtccaccctttttggaggcaatagttgccattttatcaatggtttggtcagccagattatattcttcagcccacatataagcgtccgccatgatagcccatacgccacagatagaaatacgcttgcgttcgtaattcttattacggttaatcaggctttccgcctttttcaggtcaggaagaataacatgttccagaatataattcttatctgtacgttccttatagatagcctccgaatacttttcagtaggttctataaacaaaggtacgtctccccagacacggatagcatagaaataagccagagcacgcaacgcatacgcttgtccgaggtaatcattacggtctgccacatcaggcatactgatattaggaacatatttgatggccagattggtctggttaatcatctgatacaaggtcgtccatttcgcacatttctcgtccgtagacatcaggttattaatcacacgtgcctgatcggccatcaccggtgctccgggagctacattatccgaacggaactcaccccaataaaaataattctcgcgtaaagtggaacgcaacaatccatagatttcatttatacctgctttagcgtcacgggcggtctgccacatgtcacctgccgggatttcactcaccggttcctcattcagaaagtctgaacagctattcaatgatagagccaggcatatagctccaacaaaatattttatattcttcatacgatatcttcaattaaaagtttgcagaaaaaccaataccatattctctctttctcggatagcggtaagagtctttacctacctgcagaggattacttgtagagaattcaggatcgaatcccgaatagttggtccatgtcaatgcgttgtttacaaaagcgtagatatttatattcttcaacatcagcttctttatccagttttctggaagatcataggctatacgtacgttctgcagacgaataaaggaagcatcttccagatagaacgagttacccatacgtgcattgttataatcatcattatacggacgcggatagatagcctggtcgcccggatgcaaccacatattatgaattacttccggtgaaggagtggttcccgtatatttgaacatgttacgattatgttcagcggcattataaatctgtcctcccaaagaataatagaatcccaaatacagacttacgtttttccaggtcacggttgtattcaaaccaccggtcacatcaggcatggcattaccaatcaccatacggtcgttatcatcaatcacaccatcccgggttccttccggttcttcccagttgtaatctccgccacggaacggtttgccgttcggtaacgttttctggcgaatatcacctgcatattcctttccattcaataaatacttgtattggaatacaccattttcaaacaccggagtcagttgctcccatttatctgtaaaagcattcgattcgtcataagcaaagacaccggcacttttaaatccatagaagtcacctacgcgaccgccttcctgcatccaccagatatcaccttccatatatgccttaccttcagacagtttctcaatgcggttgatatttctggagatattgaaagaagcattccacttccagtcctttgtgcggataatatcaccggtaacggcaatttcaaaaccgcggttgctcatctcaccgacgtttgtcttcatatatgcaaaaccggattctttaggcagttggtagtttgccaacaaaccgtctgtatatttatcgtagtaatcagcagtgattgtcaaacggctattccagaaattcaagtccaaaccaaggttgaattgtttggtttcctcccatttcagattgtctttaccgatacgggtcggaataacgccgcccactccgtcatagatagaattcggagaataagaataaatataatcataatttccgatcgcttcattaccggtgataccataacttacacgaatcttaccatcttccaggaatttcttcgagaacttcatgaatttttcatctgagaaacgccatcccactgacactgacgggaaattaccccatttgttttctttcgcaaaacgagaagaaccgtcacgacgcatattcgctgtaaacaggtatttccccagataatcatacgtcacacgtgcaaaaacggaagccatggagtgattactcaatgtagatcccgtagaggataaatccagattggcagcaaacgcgttcattgtataaataaagtcggtagaggaattcaatcccacaaaagtttcattttcataacgccattgttgagcactgacacccaccatcgcgctgaaattatgtccttttatcttgcgtgcataagtgatgaaatcttcattcatccagttccagttgaggtaattataagaataccctttattctgtttctgccattcatcagtaataagactaggttcgagttttttgcgcttgtccaaatagaagttggcatttatattggctctgaacttcaggtacttgttgaatttgatttcaaagaactggaagaagttagccttataagaatccgtaaagtcagtggtataattgacctgtgcaataggattcttctgaccattaaacaccccgaccaaagagccatccggataataagtattgaaataaggacgacgagtcaacactgcgctcaataacgtaccttcattcagacctttctttttagaataagtaagagaaatacggctacccatattcatccagtctgtcggtgaataatcggagttgatacgagtatttaatctttggaaaccagtattggaaataatacccttctcgttataataaccggtattgatgaaatatttcagtttctttgtaccgccacctacgctgatatccacctgatctttctgcgcagtacttgtaatcatgtccagataatcattgtctacattgaagaatgaattcaacggatcatccagaatatcaatactttcatccggattacctccgccgtatgtttcaaaatactctttacggtactggtcgtacaacagacgctctttacgatttgcctgtggcaccttatgagacaatgtaccccacgagtgattatacttgatatcaatacgggctttaccctcctgaccactcttggtagtgataataatcacaccgttagccgaacgggaaccgtagatcgctgcagaagccgcatccttcaaaatttccatggaagtaatatcattggtattgataccatcgatactttccaaaggcacaccgtctacaatataaagaggagtaactccttcggcggagaaagtggatgtaccacgaattttaatagaagaagattcaccgggttgtcccgagccggacactacctgtacaccggcagtagtaccttgcagtgcttcaaaaacattggtagccatcttctgctcaatagcctcacttgagatggaagtaatagctcccgttacatcacgctttttcatcgtaccataacccaccaccactacttcgtccaacaacttagcgttctcttcaagcgtaatattcattgttttatctttcactaccacatctttaggggtataccccatgaatgagacagtcaaagtaactcccttctttgaaacattcaatgagaaattaccatccaaatccgtaattgtcccattagatgttcctttctccatcacattggcgccaggcaaaggaaatcctgttttatctacaataactcccttcactgcaaacccgccttgagcataagccggattaacaaggaaaaagagactcaaggaaatcaaaaggaacgactgaaacaaccgcacttttgtcctactctgcaaatttttcataactagaataaaattaaattggttaattatcaaggttttactcactacttaattaattaggagaaatacattggctctctcccgtaagatgttatcttttatttatcacataaataatcgtctttcataatactatacaataattattatattagaataaagattacacagtacctagtctgctaatttaaagtgtgtgcgtacacacctaaccaaagaaaactcaagtacaagctggcatgatccaacgccacaaaagtatcggatttgagcatattgcaccctatcgaattgttcgttttatctagtctaaaaattcagatgacttattttaatcactttacagagggatcggaaggggcatcatgagatttcctatactgtgtaggagcaatatcaaaaagttctttaaagcatttattgaagtattgagggtttccaaatcctaaccggtaagcaatatccgaaatgttcatctccggagcattcagtagaaaatatgctgcttttttcagacgaagattcatgataaaattatttggcgtacttcccgtaataccttttatcttctggaataagacggtacgtcctactcccatctcccgtgagaaagtatctacactgaattcgggattttccatattatcttccaccacttgagtagcttgttcgataaacttctggtcgagttcattcgtcgcaatcttctccgctttgctatccagttgatgggcatatttattctgtaagagtctgcgggtattaatcagattattgcattgcataaccaaccgccgcatattaaatggttttaccacataaatatccgctccaattctcaatccttccaattcacgttccggcgcactaagggcagtcagaagaacgacagggatatggcaggtttctatattgttcttgatcttggcacataactctgttccgggcattccgggcatcatgatatccgaaataaccaggtcgggttgcattacctttactttctcgtacccttccttgccatcacttgcagtttcaaccgtatacaacggagagaagatatctacaaggatatttctgatttcttcattatcatcaatcaccagtaatttacagtcagtagtcccgttttcactttgggctgactgcacctctttaaccagcagttctttgtcttccgaataataaatatattccttatcctgctccggttcaacccgggcgacagaagaatcaaagtgagcatccccttttttcagagtgaccttaaaacaagaaccttttcccagctgactttctactgttatatctccctggtgggctttcacaataccctgactcaaagccagcccgataccagttcctccatactgtcctatattctcaacctgatagaatcgttcgaatatcttaacatagtcttcctcggatattcccgcaccattatcggaaacggaaaacatacattcctccgttccatcagccaattccatacggatagttccaccgtctgaagtatatttaaaagcattagatagcaaattattaaccaccttctgtatttgcatccggtccccccacacgaggcattgctcgcagtcggcatgcaaaacaaacgaaatattcctgttagcagccaactccttaaacaatacataatgctctttgagcaaagaatataaatcaaattgagaaactttcagtttcaaaagtccctgctcctgtttccggaaatcaagcagctccgtaatcaatgatttcaggttacctgcatttttatgtatattcaacagtttcgaataagcataggtagacaatttgccggaattcagcaacagatcaacctgccccaagataagagtgatcggagttctgatttcatgcgagatattcgtgaagaaacgaagtttggattgattcatctcttcaatgtattgtttctcgcgaagttcaaaatccaatgaagttttcaggaacagacggattctatattctctcacaatgaagaataaaatagtcagaatcacgcatacataaatagtataggcccaccaagtggcatagaaaggtggcgtaatcgttatatccaatgatctgattacttccgggaagtttttcagcctgatctcaaagacataatcacccggagagatattcgtataagtaatatcatttcccaaacggttctcgctccattcatcattataccccatcaaccgatattctacctcaccaccgcctatatgcagaaaattatctgttgagaaaccgatagaaaacacattttgcaagtaattcaatttgatccggccggtataggcaaaggatttatttaaaataccggtttgatcgcctgttgttatctctttgttgttgacatacaaatgagccaactccagatcgtatattttcggaggataatacagactactttcacgaatggttaccaatccggtagctcctcccatataaatatcatggttacgggacacatgcatggatttccggttcacaagagtcagcgggaatccggttttagaattgaagttgattaccttcccctctttctgttccagcattgacaatccatgcccggtaccaatcagcaaattcccggaaggggtttcccccagtactctgatattttctcccgacaacacactttcaggagtatgtaaacgaaacaaacgttctttcttatccagcaagaaaagtccgttgccatgtgtccctacccaaatatttccctttcgatcttcatagataacattgaccaactctttttgagatctgacccgtttcttcagacttatcctataggtttcaaaccgcttttcatcaatcacataagctacacaaccgtcatcggcagcaaaccataatctgtttttcgaatcaagtaatagggtgttataattatgtgtaaacagttccttctgatgaaacaacacctcggatttcaaggtctgtttatccaaactcacaatagctgatgttgtcccgacatacaatttacgaggcgtatctgccaaggcaaacagggcctctcctacactttcctctccaagcggttcaagattatagatgtcgttccgatagttattaagatgaaaacaatttactttatttgtaaagtctgcagcgatccacaagcagttattagcctcatcaaaaacgacatctttcagataatccgtactgaaatgatatccggtatgcgcattaaaatgcttgaacttcccttgtcccggttgatataaatccaatcctcctccttcagtacatatccatatattcccggatttatcttctgccatagctcccaccaccggaaaagacagtccggtgtccgaagcatgataatggacaaaatgctgatattccggagagaaaaagttcacaccaccccaataggtccccacccagactgttccttgtttatccgtataaagagacgtcaccgaacgattggacatagcacccacccggttaggatcagcctgataatggaatattttcccagtagccacttcaatcttactcaatccacttctgtagcctacccatatattcccttccaggtcctgacataacgctctcgccatatcattccgaaccgtgtaaacactcttatcattatattcatagtgatgtatgatcgtaccttgaggtgaaaaacagaaaacgccctgatcctgcgaaccgatccagatattctggtcgttactttttatcagtttcatcactttaattccaggcaagtgaagtgatattgatccacaagtatctacacgcatcaccccaccctctttcaaagcaatccagagacttccatcggaaccttccaccatcgtcgggccactatccggcaactgcaaatcggcatacatcggtttcaataggcgggtattcttatcatataagaacagtttccctccttccgcaatccacactcccgtctttcctttggcaagagtggtgggagaagtcaccggaagaatataatatttctctgtttcaaggtcgaactggaaaagtccggtagaggccaacaggaaaagacttccctgaccgtcttccaccatttgagtcacatataaattaccataactgatagagtcgttatgaaagtggttgaagactttgatgtgattgccatcgaaacaattcagcccgtccaaagtggcaatccatatacgcgatttctcatcctggcaaatatcgctcaccgttatttgcgacaatccatcttccacacccaatgttctgaacttgtattcctgtgaccggagtggaaatacaaatccaaaaagagatagcagaataaaaaaatggatcttagatagtctttgttcgcgcatatcaagaatgatggtttatagcacacattaatctcgtcacaaaagtaacagtttttatgatattcccaaaatcagagcaaaataactgatagatatagacttcaccctattttattcttcccgtccgaacgaacgatattccaacggggtaagccctgtacgtttcttgaaaaaagagaaaaaatattcggtagactggaaacccagaaaaaaagaaatctctttcacggattgggaagttcctactaacatttgtttggctttacggagtttcaattcctggaaatatttggcgggagcataaccagtatactccttgaaaacacgtcgaaaccatgaataactgatgttaagccgcattgctaactcttccggatctacattaccggaaacattttcattcatgatgattttcgcctgttctatcttctgatccacatcactcatctcgaaaactttattcttggagacagaaagaatcatacctatcatgtggagcacaatcccggaaagatattgttgcgcagaaatcttatccgcttcagctacagcaagagcacgggagaacaaggaaaccaactcttcattaataccgatttccaatatttgctgctcctgcgacaaaaaagcatcattaacgatggcatctatcattggcccctcaaagccgatgtaatattccgtccaaccagtctgccgtaacgggcggtaagtatgccattgcccgggaaacaataccatcagccggcctttacaaacctgcttttcagaagtggaatcggatgaaaacaaaccacgcccttttgtgatatagaccaactgatattcgcgaagcacccttcctttttccgcattaaaaaagtaaccggagggatgctctttcaatggataaggtgaatcaggagggatagactgatagccgacggtattcacccacagcccgaatttacggtccatgtcatttacaatcagatatttaaattccaatcccaaactattatcctcgatcatatcagagtgttttcatgtaattgagttggacaaaaataggaattattttcagaaaacacacgcaagggtataaaaaaacatccggagtgtactttcaagtatccccggatgtttatataaaaacaaactttactatgacgagatttagaatgctttatgatacaaggcttcaatatccgctaccgaagtaggacgaggattaccacctgtacaaacatcattgaaagcagctacagccaatgcaggaatgtcttcttctttcacattgatttcatgcaatttctgtgggatattaatgctgatagaaagtgctttcacagcttcaatagcagctttaacgccctccgcttcactcattccggtagtgtccactcccattgctttcgcaatatggatatatttcggagcagccggagattcagcattgtattccatcacatacggcaacagcaaggcattagctaccccgtgaggagtatcatagaatgcacccaacggatgagccattgaatgaactattcccaaaccgacattcgagaatcccataccggcaatatattgtgcctgcgacattgcttcgcgggctgccacatctttaccattgtctacggctgctttcagattttgtgcaatcatctcaatagccttcaattcgaacatatcgctcattacccaggcaccgggagtaatataactttcgatggcatgtgtcaaagcatccataccggtagcggcagtaagccccttcggcattgagtacatcagttcggggtctacgatagccacggcagggatgtcgttcgggtctacgcaaaccatcttcttacgggcatcttcatcaataatcacataattgatagttacctcggcagccgttccggcagtagtaggcagtgcaaaggtaggtacagctttgtgtttggtatcagctaccccctccagagacttcacatccgcaaaatccgggttattcacaacaataccgattcctttggcagtatcgatagaagagccaccacccaaagcaacgataaaatcggctccggaagctttgtaagctgccacaccgttttgcacatttgcaatagtagggttagcctttacatcgctataaagttcgtaaggaatctggttctcatcaaatactttaataatttcagcagccacaccaaacttgataaggtctttatccgttacaaaaaaggctttcttaaagccacgtctagctgcttccacagcaatcacacttcggcatccggcaccgaagtaagaagtttcgtttaaaataattcgattcatggttgtgctatttgttgttttatttaggcagattgaaagcaacagtcatttctttcatctgttcctgactcataccatccggctcgaagcccatatttttcgctgcgatatagatgagagccgatttattaagtacatcgatctgatcgaacgcctgcatcgcatcgcaatcaactgcaaatacaccatgtttctcccacatcacaacatcataatcctgcaattccttgatggtagcttccgccaattctacagaactaggcaatttataaggaatgatacccaaaccacgcgggcagaatgcctttgtttcgggaatcatactccataacaaattagtagccacatctttttccaggaacttcggacaatgtgtcatggcaatcagttcgatcgggtgtgtatgtacagatgctttataaggagagtttttactcaacaggtcattatgtacgctcaagtgagaaggcaattccgatgtcggcgccacagcctcgtctgcaataattacgtagctggcacagtcatccagaatgcggatcaccgaaccattctccatcggccaacgagctaaatcacgcatgcgtttattagttcccttgcagtagaaatagcatcctttcagataaggaagagtcacaccgatagatttaacttcactgatcggtttcatctgacggatttcatcgtctacaaactctgtgatattaacagtgatattaccaccgttacgttcagcccatcctttctgccacaagtatccggcaacttctgctaccttatttacttctttggcaagtcccggacgattctctaaaattgatttcattctatatataattttaattaggcatggattacactgattttgccgcaagttataaaaaaaccgcgtaatccatgtaatccatacctaaattttttaaaacaaattcgggaacactaatgagaagataagcacgatcagaccagctatcagcacagttatggtcttgtttgacacacctttccattctttcagaataattccccaaacattactaaatgtgacattcaatgccatcaaaatacaccaggagaaagccagcaataccggactttccgtaaggaaactcttacccatttccagtccgaagaactgcatgtaccataatacgccagccaacgcacaaaaaactaaattattgccccagacttttcctttagcatagtcacccattgatttattagccacattctgttgcaggcagtaaactgcatttgtcaggaacccgccaaatgtaaccaggaaaatcaccgggagaccggcgtaaagtccttccactccaccagctaaggcagcttccttgataggtgttcctgcatccagtcccaaagcgaagcaagcactcatgacaccggccaggagtgcaaccagtaacccttttgtcaatgcaaagtcttttacagcagcacgtttttcttcttcgctcatgttttgcgcacgcaaactaccggcatacccgataatagcaatacctgccaacgtgatgcaaacacccaacaaaagaatcagcccgttaccttcaaacaagtttgtacctgcaaaaagagccggaagaagggttccgaaaccggcacaagtccctaatgagatactctgtcccagtgcaacccccaaatagcgcatggaaagtccgaaagtcaaacctcctactccccacaatataccataaaagatgctcattccagcacctcccgctccccacaagtcgaacaaactgctctcttggggtacacccagtagtgaacccagaaacgggaacactaaccaggcaaatacaccttgtattaaccagaagctttcccagctccattcctttacctttttaataggcacataagaactggactggcaaaagctaccgatggctataatcaataagccgattaaaatatccataacttatcgtttagaagttacttcggcttcgtacttttcgatttctgcgatgaaatcttcacctacaggaacattattcttcaagcagaacatatcccaaactgcattccaaggcagcgctttttcttcttcgagtagagccagacgttggaatccctgtccgtttgcttcgtattcacgcaacttggcaatcggttcgagcagagcacgagtcatacatttctgtgcagcacggctaccgattacgtatgcaccaatacggttgatagatgcatcgaaatagtcaagaccataatgtacacgatccagagcaccgcaacgaacgatttcgctgaacagttccatagtcgggtcatccatgatagttacgtggtctgaatcccaacgaaccggacggcttacgtgcaacatcaattcaggaacataaagcaataatgaagatactttatcagctacactttctgtcggatggaagtgaccggtatccaaagtaatcatcttattgcgagaagcaccgtaaccgatatagaagtcgttagaacctaccgtgtagctttccaggccgataccgaacaccttagattcgatacaatctttcatattcttatattcggtagcgaaaatctgatccaaagaatctttcaacaacgcacgatatttcattcggtttacagtgatatccttgcttccgtcatgcacccaaaggttcatgatacatggatcgccctgtaccttacccatttcttctgcaactgcacgacaacgtttggtatgttcaatccagaactgacggataccttcatcaggattagaaagtgacaagtcacctgatttcggatgagagaaagaagtagagttgaagtcaagtttcatgttatgttctttaccccattctatccaactcttgaaatgttccggttccacttggtcacggtctaccaccttaccttggaaatctccatagatttcatgcaagttcaaacgatgagtccccgggatataagaagcagctttcaagatgtcagcacgcagttcatcaatgttacgagctttgcccggataattaccggttgcctggatacctccggtcaatgaaccggcctgtacttcaaatcctgcaacgtcatcagcctgccagcagtgaagtgacagatgaaaatcctgcatagttttcaatactttttcggtgtctacacctactgctgcataacgttccacagcaatttcatacgctttctgaatcagttcttcttttttcatgatattctattagttttaaaaatgattattctgtcgatcgttctatttatttccgaacgcaatttttaaaatggatataagccgcgtcccaaacttccgtatcttgcggctgataagttttcaacgggatagagcggttgattaactggcgcataccggcaacatccgttgcttcacctgctgccattgcctgaatcatcacattaccgatggctgttgcttcagatggaccggctaccacaggaattcctatcgcattggcagtaaactggttcagcaaatcattccggctacctccgccaatcacgtgcaatgtttcaatcggacggggagaaagtgaacgcaaattctccaacacctggcgataacgcaaagccaaactttcaaagatgcaacgcactacttgtccgcgtttctcgggaaccgactgtccggtagcccggcaatattctgtaatagctttttccatgtccgcaggattcgcgaaacagtcatcatccggattaatcagactacggaacggttcacaagcatccgcctcactgattaattcaggataacttgtatctccccaattcagacggcaacgttccagcaaccacattccacagatattcttcaatagacggatagttccttccacaccaccttcattggtaaagttcaacgcttccgtttcagcattaatcaccggagcatccgtttcaactcccatcagtgaccaggttccgctactcaaataagcaaagttgcgatccaatgccggaacggcagcaacagcagaaccggtatcatggccggctaccgcaatcacaggaattgcacccagtccggttatcttttgcacttcttccgtcaatactcccaccttttcacccgggaatacaaaacggccgaaattcttctcactcaatcctaccgctttcagcaactccggctccaaacgtcgtgtctgtgcattcaccagctgggctgtcgaagcaatcgtatattccgtcaccatctctccggtaagcatataactcaacgcatccggcataaacagaattttatctgccgcctccaacgcactgtcgtgattgcgacgtaaagtatctaattggaaaagtgaattaaaattcataatctgaatacccgttttaccatacactttgctacgggaaatacgggagaaaagagcctccggtgctcctactgtatgcgggtcacgatatgcataaggctggcgaagcaagttaccgtcttttccgacacatacaaaatccactccccaggtatcgataccgatagaagcaatggactctccacggtgagcaaccaacttcaacccgtcaagaatatgacgatataatgcataaatatcccaatagaaatgtccacctacttcaaccaggtggttaggaaagcgattaatctcttccagatttaatccgccttcaatgaaagttcctaagattgtacggccgctcgttgcgcccaggtcgactgcaaaaaagttttgtttcatggtattctgtctatatatttaaggtatccatttacctacatggcaaagataggcgattccctcctccttttccttatgtattttgattgaaagggtatacattttgacacaaaagacaaaagacacaatacaattgcaaatataaacagattcacattttccctacacctctgtataggtactaataaacggtataaagccatctttgctaaatggatttataccgtttacaatatataaaatacctattttatgatgaaatgattaagatctactttctttttactataatatgagttgttacacgacgttgtccatagtggttaaagactccattatcagtaggataattgacaacatctgtttttgccgctcctttccccttcacatacatagtagtagatccaccaccatccatattaagtgcatattgaggattgaaatgctttttgaggaataaggttacttcttttgcgctcataccttccgccttaccagcccagcgcccatcaatagtgactaacaacaaatctttatcctctgtcacagcaaccaccgtacgaggatgacgtactccttgatgtctgcgataatcttcatagtcaaaagactccaattgttccatagtataattaccaacaaaagtttcacctaacggattgtaatcgtcaatcagtgtgggggcactagctaacaaatactttgcagaatgttgtttatatgtatcaattgcagcctttccatttctgccgccatatataattccaatatcagattttccatccgaataaagcgcaccatcatgtttccagtatcgtaaatgtccctccggtagtgtcacttcagagatattagttccattgatacgaatataaatagcttcctgttcatacccaccattaataccaccaatagccccacgtacttgtgctgtagttgaaagagaatctccattattatatgtaaattcaactttgtacttattggaaagtaaatcaatttccagcacatttacaatctgttgagccttactcacatcgtcataccgttcatagttataataaataaaaccatcatcgatagaatcaattttccattcatcttggacattcttctgtagagtcggaacttttacaacggaagggttgtccggttcgtccggttcatttggtgttaccggctctgtaacatccggtgttttggggtcatcattgatcccatcacttccacaagcgacaactagacaaaaaaatacggataaaaaagcaattgttaacttcgtaaacttcataatataattttttaaataaacatatagattccctattcgtatcattacttatcattaaaagatttcaataatggagttacgcctgaaagatcccatatatctgtagaccaacctattttcttagcagcatctacactattttccgtagtaataccatggcaaattgcagttttattgttaccccaatcataagttccggcagtattagcatcggcccccgtcatacctttgttgggtccccatgcgataatcatatcttttttcgcataacaatccgtagccttcgtataggtatttgactgccatccaataacacgtcctgatacaggttcaccatcaatctgttcattccaagcgatacaaccttttattgtaggattattgccattaagtcctccggcaataccacctgcatttcctgtactataaagagttcctgtcgcaaaacagttttcaacaactacagcattccttggttcagcaacaataccaccggcacgagaagacccgattacttttacatctgcataacaattccgtacagtacctttagcaaaaatgccaccaataccacccacttgctgtatgccacttacagtaccagacacatatacattttcaatcaaacactccaaagcatttgttcccaaataaccggcaacaatacccgtacaagaagaaccatatccaataacttccgcattttcaaagcgcacattacgacatgaaccattcattaccccaaagaaactggcgtaccgagaactgatctcacaatgtaaatttctaatcgtatgtcccttaccatcaaaatgaatctttatatcaaaacggtcaacaggctcacccgtattcagcggtttccagtcaatgccagtcatatcaacatcattcgtcatttcgaaataataagttttatcaagttctacaacagacatcatgttcctcatatgattcctattgctaatcaaataaggattatcaaccgttccatcaccaccgtcaaataaagaagaagctgcaacatagatcacagtagacactgtaccttcgccttcatgatcatactgtccatttccaaccggatgattcactacgcctttacctgatgtccatagcgtggaagaacttccgtcagccaaacaaaccgcattcttcatccccaatgttttggcaataaaagctgcctcctcaagtgttgcaccatcagcatttcccgttatagcaccatcaatagtaagcagcatcatttttccctgagcagttatcccaatcacagaccgagccatacgttgtgtataaatagcatcttgaggaaacgaacacactttcccttccataagtaacattggacctgatgctaaagctgattcatattcatcttccacatccgtataatctgaaaacgtacaagacttcacatctacagaaccttccgcatcaatagcaatcactccgttcactttactggcagattcgatcgtagacgcaaccttcaccaccttatccaccatagtaaatgtagacggatttccggaaatagaataactgccattgatagcaaacaatgcttttttatctttagcaatcatactagttttggcaggagtatcacatacagcaactctggtagaaaacatagtcgtcggatataccacataagaaacgctttgggtagtcccccacatgctcgcttgtgccgtacaaacagctgccccgttacctaaatccgttttttcccaagatgctctcataagagccaatgaatccacatcccatttaatttcttggttgaaatcttttttcaacatttcgctataatctgaattatctccagagtcactacaactatagactaacgccaatagaaaagacatatataaatatttcattttcattattttctccatttaaaattaaaaaataagtccatcattccaacccgggttctgcgttaatgctccatttgttaaaacacgatcctttgttggtatcgggtacaagtaatccttgtcctcattccatactcttttgatactttgatgaataatcaaattaccacttgtctcatgatccaagctaagttcaccacctatctcaaactgatctacacaagaagagtttcctttatcagtactcaaatacagataaacatcattcgttccatcaccgtccaaatcatattcacccggaccgggaaaataaataccaagaaatggtttttcaaatattttaccttccttccaacgcatgatatcataatatctaaagccttccattaccagttctatagcgcgttcacgtctaatttcaaggataatcccctgattatcgtcactttccacgtgcggataccactccttcaaataagggtccggattagcatttgctgttgccattaataaattcggcatatttacacgagcccttagcttattaattgttttattcaaatcatcctgagtcaatgtccccaattctgcttttgcttccgcacaattcaaataaacttcggctgtacgaaacaatggcaaatcagattcagaagacatatcatatttaactccacaatcgtacttcttcagatgataccctaattttgccaacttaaagtttggcagatattttttcccgtcatcacgtacatatcctgctgcacgaatcgtttgtgttagacgcggatcacggtttttcatctcttccacaaatccaatagtctcataattactcttatctgtaaaacgagaaccatctttcatcagataagaattaacaaaacgctttgtcacacctgaatttgcctcaccaggagaattgcaaaatgcctgtacaatattagtcaatcccaaagctgcattgtaatctttcgccaggattatttccgtgggttcagcattcaaagagccaaataaattgaaataaggggtagaacctgccgtataaactgtataaccactctcattgataaagatatccgatgcggatgcacattcacgaagatacttttcccaatcattcaaaccatgatactttcgaaatgtaccttcaaacaaacaaattctggattttaaagccaaagcagtccaacgagtcacccggtatacatctttttgttttctcaaattatcaatcgcgaaatcaatgtcctccaatactttccccattacaaactcacgagaatctctaggtttactcaaagcttccgtatcagcacttccaatcacataatcataccatggcacatctccaaaacgcctcacctttacaaaataaaaataagctctaaaaaaacgtgccaaaccttcataatgattccgtacttcctcattctggcaacgataaatgttctccaggcagaaattaatatcacgaagggctccccaaccccaaccatcgaaattagaatctgtttcaggtatagtgcgttgcccgctaatcgctttttccaagataggctgaataattacatcaccgtaatctttaaacactcctgtacccgaaatacaagcgacatagaaattgtttgaatacaattctaactcgttttctgttgtaaagaatgtttccggtgtaattttatcttccggaaatttatccaaaatactttcacaagaaatcattgccatcagaggcaagagcatccatattttatattttatactactcatattatcctagtttttattttccattaaaaagtcacatcaattccaaatgaataggtcttactcattggataagaagtcacgttcgtatgaccacttttccagctcgtagaagccccagcatgttccggatcaatataattactatgtaaagggctgaatgtaaaaagattctctccactaaaataaaccctgacacgttccatatgcaaagcctttagccaagtacgtggcaaagagtaaccgactgttacatttttaagacggcaataagccacattttgcaaatagcgagtattaggtttagacaactcacgtggattaacatccaatgccacatagcctctcggacgtgggaaataagcatccggattatcttctgaccaaacatctgtcaagaaatccttcggaataaaagtacaataaggacgggcatagggaccccagaacagactagtttcaccattgggataccaatgttggcgaccgacgccttgcaacaaagcagaaaaatcaattccattccaatctgcagctaatctgacagaatatgtatatcttggtaaagaatttccaatcactttctgatccttcacatcgtttgccgataaagtaggagaaataatattatcgccatccaagtccacatatttcacatcccccgcatggagaccttgagattttacagaaatattcaatatattatttacgtaactctgatttaccggatagttttcagcttcttcatcagttttgaagagaccatcaacaacatatccccaaatctctcccagttgttgtccttcatatggagtgcccaatgttttgttatcattgttatactttgtcactttagtcgtattatcagccaagcctagtacgacagaataatggaacgcttttccctttagattaaaagaatcattccaactaatcgatgcttcccaacctttcgtacgtaagttagcagcatttgtttttggagaagaagcaccatatacattcggaagatccttggaagccatcaacatatctttcgtatcacgtacatatatatcagccgtcatattcaaacgattattcaatagtccgagatccaaaccgatattttttgtaacaaccgtttcccaagtgaaatcagaagcattcggagcagagatactagcacctgacgctttatttttatcaccaaaagcataagaaattgtaccaccagaagatatagtctgcaaatagtcataatatccgacttgttggtttcctaatgctcccaaagaaaagcgtaatttcaaattactaatttgtttacgtaatggtgcaaagaacttttcttcattaattctccacccggcagaaactgaaggaaaaaagccatagcgatgtccccgggcaaaccgtgaactaccatcatagcgtccgctaaattcaaataaatatctatttttatagtcataattcaaacgataaaaaagaccgaaaagagcatatctatttttaccacccgcaatactcatttcatcaccattagctaaattaaaatcagttaaatcttcggacaataaatcattacgttgtattttgatgtctttaaaaaatttagtttcataattgacaccggcagttgcacttacatggtgcacatcggcaaatgtatttgtataatttccataaatattgtatgaatgaaaccaatcatgattagaacgttcataaagagtattaaggccataaccatctgttttccaaagaacttctccgggtacacgtgaatatggataattagcactacgattcattgccgtatattcatgttgagcaaacgaataattagccgtcaccgttacattcttaacaggtgtcattaccgcctcaaaggtggtattaaaaaagtaattagtatcctcattcttgtgtttaccgtattcaagaattgcactaagatcattagcagggcgatatcctcctgtaataactgttgcattccccatatatgtaccatccggattgattggaacaatagaagctaaggcatgcttacttatcgcatcaaaaagattgttaatagcacctggccccggaaatggataagaatcctttttgtatgacgtattattacttatcttcaaccatggagcaatctcaatacttaccttggaacggaaattgtatttagtgaaactatccatatttttccgaataactcctttctgatcataataagcaccggaaaggaaatagtgcactttcttattgccaccactgacactaatattgtgttcccatgtaggacgagactcatccatgaagtagttataccaatcaaagttaccataatatttatattcaccatctttgataaccacccacggtcgttccggattttccgttttatcattacgccggatccacatttcataataatcttcatcattataattcgtatagttagaaccttgataggtagaataaaacatatcattgatagccgccgaataataaccgcgagtctcaaaatctctggaaactgtaggtgagccaaagctataacgtccgttataagaaacacgtgttttaccatcattaccagattttgttgtaaccaaaattactccataagctgcacgagccccatatacagcagccgaagaagcatctttcaatacactaatagactccacatcattgggattcacagcatcgatagtaccttctacaccatcaactaatatcaaaggcgtggcactactactgatagaattgataccacgaatatttatgctaccaccctgtcccggacgaccgttagaaacagtaacattcatattaggaacagctccttgaagtagtttagacaaattatcggccgaacgtccgattacttgtttatcgtcaaccacagcaacagcacccgtcaaattgatttttttctgtgtaccatatcccacaacaactacttcttccaaaaccttggtatcctcttccaatgtaataatcaaagttttaccatcctcaacttttacctgttggtctttataaccaatatatgagatattcaacacattaagctttccttcttctccgtttaaagaaaaatttccgtttacatcactcaccgttcctctattgcttcctttcagagcaattgtaacaccaatcaacggttcaccgttcgtatcaacgaccttacctgtaatcttcttcaaatttccatcaggcgcaaatcttttactagacaaaattatgcttttatcaagcactgaataaacaacgtcacttcccttaaaaacctcatctagaattttaaaaatattctgtttattgacattaatagagacacgtttatgtacattaacctgctgactgttaaagaagaatacaaagtcagtccgcgattctattattttcaagacggtttcaatcgtttgattattgactttcaagtcaaggatcgcattttgcgcataagtatttgtcgcacgaatgcatcctatcgaaacacatagcataataattaataatctcataggcaatggaattccttttaaagttgctttcagtagccttttaatcccaagaatttggatactacaatgtttttgcataaatttgttgtgatttaaattaaaaataaagttaactacacttgtcggcaaacaagtaaggctaaatgattttttatatgggaagaatagtgctatatttttcccatattttttgtttaaggagggagtgttttcatagttcttttttgtttaataaatttctattattgttttctctttcacaacaccgttgtccaatgccgattcaagatatctgtatctcacccctgaagctattttgaagtgttccaagatcttatccagacgttgattaataaaagtacctgtaaagcaatatttctttaataatggattaacaatacggaactctacgtcaaaacgcttgctcaaagttcttaaagcatcttcaagaggagtatctcgataaatgatccttccacttttccaagcaatatcagattcaacaaaagtagttgtacacaaaagtttctcatccaataaattataaatcaccttctgtccgggttgcatactataagtaacctccctgcctttctgctgacaatggaattttactctacctgtcaccaaagtagcaactacaaacttatcatccggataagcatccacgttaaattcagtacctaaaacctctaattcaatcccctttcctacatcgactaagaatttccgtccattatccttttgtactgaaaaataagcttctccgagcaattcaacctttcgatattctccttcaaaagacactggatattttagataagaagcagaattcagccatacccaagtaccatccggtaactccacttttgtcatcatccccggattagaccgaatttcgacataacgatcataatttttatcttgattaaatacaaaatagaagaaagataagaataaaggaataaataacacagctgctgctcttatcccccattcccaccagtttattttcttcctttttgacaatctcttatccagcttcaccaatgcctgtttaggatctatctgcttcacggtatctattatatctgttacgtggtgtatgtaacaaatctgtttagctatttttctgttctcttcagagagggaaatccaattttctacctcttctttttctttctctcctagtgtaccggaaaaataaaggagtaaaagagcctcatctatattttcatgtaattccatcatcttttatgttcattttattaagaagacggaatacttcaattagcccctaaacaaaaatgcaacttttttaattaaaagctgcatttttattttaagactcaaaaacgaatcggctatccttagagaaaataagggaatatgattgtaatcaacggtaaatagtcttttagttctacacgtaaaagtctcaatgcttgctggatacgatactccactaattttatggaaacgtttaattctttcgcaatctctttatatgttttatcttgataacggctcatctcaaaagttatacgataggagtccggcaatcgcatcacggccttttctattttcgccatcaattcctccactacataaaaatcaggatcttcaaaacttgtctgcatttctttagcaaacatatgctcataacaacgtctttttgtctgattcttacttattaaatccaagcatctgtttctgaccgccataaacaaataacttcgcaaagaagtttctatgatctggaattctctgttttcccatagccatgtcatgatatccaaaacaacttcttcagcatcttctataggaatatagtacttcccgaaggcacatagtatggaataatacttcaaaaataaagtatcaaaagcctttctatctccttttctaaaaagagaataaagctcaatatcttcatctatcatacgatttgtctccttattcactttacaaatttatatatttaaaaatccctaaacaaacaattgcatcttttttaatagacaataaaaaaagtcagcacaaaatgaagcaataaagaaacaactttgttacatatacccacatatatcctgattatatcactatccctttctaaagtattttcacttttatgcaaaaaaactttggttttatgcatcttttttccaaaataatgcatacttttgcgccattcttagaataattatacaatgaagaagaaagcaaatcggttagacgccatcaaaatgattatctcgagcaaggaggtcggttcgcaggaagaactgctgcaagagctgaaccgcgaaggcttcgaactgacacaggccaccctttcccgcgacttgaaacaattgaaagtagccaaggctgccagtatgaatggaaagtacgtatatgtactgccgaacaacattatgtataaacgttctaccgaccagagtgccggtgaaatgttacgcaacaacggatttatctctttgcagttttccggtaacatcgccgttatccgcacccgtcccggttatgccagcagcatggcttatgacatcgacaacaatgaattcagtgaaattctgggaaccattgccggtgacgatacgatcatgttggtgttgcgtgaaggagttgcaaccagtaaaatacgtcagcttttgtcactcatcattcccaatatcgaataattatacctattattatataataaagaaatggacactcaacaaatagatgttatggtagccgacgcctcacatgaggtttacgttgacactattttggaaactatcagaaatgctgccgccgtacgaggaacaggaattgcggaacgcacacacgaatacgtagcgacaaagatgaaagaaggtaaggcgattattgctctttgtggcgatacttttgccggattcacctacatcgaatcatggggaaacaagcaatatgtggctacttccggtctgatcgttcatcccgatttccgtgggttaggactggcaaaacgcatcaaacaggcttctttccaactggcacgtctccgatggccgaaagcaaaaatattcagtctgacctccggagcagctgtcatgaagatgaacaccgaactgggttatgtgcctgtcaccttcaacgaactgacagacgacgaagctttctggaaaggatgcgaaggatgtatcaaccatgatatcctggtagcgaaaaaccgcaagttctgcatctgtacagccatgctatacgatccgacagagccgcggaacatcaaaaaagaacaagaaagaaataacatttaaaagatacagcactatggaagaaaagaagaaaaaagtagtggtggcattcagcggcggactggacacatcgttcaccgtcatgtacctcgccaaagaaaaaggttacgaagtatatgcagcttgtgccaatacgggtggtttcagtgaagaacaactgaaaacaaacgaagaaaatgcttataaactgggagctacgaaatatgtaacaatagacgttacccaggaatactacgaaaagagcctgaaatacatggttttcggaaatgtgctgcgtaatggtacttatcctatttcggttagttccgaacgtattttccaggcattggctatcgcacgctatgctaacgaaattggtgcagacgccattgcacatggttctaccggcgcaggtaacgaccagattcgtttcgatatgactttcctcgtactggctcccaatgtggaaatcatcacattaacccgtgatatggcattgagccgtcaggaagaaatcgactatctgaacaagcatggtttcagtgcagacttcaccaaactaaaatactcttataacgtaggcttatggggtacttctatctgtggtggcgaaatcctcgactccgcgcaaggactcccggaaacagcttacctcaagcacgttgaaaaagaaggcagcgaacagctccgcctgactttcgaaaaaggggaactgaaagctgtcaacgacgagaagtttgacgacccgatcaaagccatccagaaagtggaagagattggcgcagcatacggtatcggccgtgatatgcacgtaggcgatacaattatcggtatcaaaggccgtgtaggattcgaagcagctgccccgatgttgattatcggcgctcaccgtttccttgagaaatatacattaagcaaatggcaacaatattggaaggatcaagtagctaactggtacggtatgttcctccacgaaagtcaatacctggagccggtgatgcgtgacatcgaagccatgttgcaggaaagccagcgcaacgtaaacggtacagctatcctcgagcttcgccctctttccttctctacggtaggtgtagaatcggaagatgatctggtgaagactaaattcggagaatacggtgaaatgcagaaaggctggacagctgaagacgcaaaaggctttatcaaagtaacttctactccgctacgtgtttactataataaccacaaagacgaagagatatgattaaagcaggaatcattggtggcgcaggatatactgcaggcgagttaatccgtctgctgctcaaccatccggaaactgaaatcgtatttatcaacagcagcagtaatgccggaaacagaattaccgacgtacacgaaggcttgtatggagaaacggatttaacgttcaccgaccagttacctctggacgaaatcgacgttcttttcttctgtaccgcccacggagatacaaagaaattcatggaaagtcacaacataccggaaaacctgaagattatcgacctctccatggactaccgtatcaaaagtgacgaccacgactttatctacggtctgccagaactgaaccgtcgcgccacttgtacggcgaagcacgtagccaaccccggctgttttgcaacctgcatccagcttggtttgcttccgcttgccaagaatctgatgctgacagatgatgtaatggtaaatgctattacaggaagtacgggagccggagtgaaaccgggtgctaccagtcatttcagttggagaaacaacaatatgagtgtgtacaaagcattcgaccaccaacacgttccggaaatcaagcaatcgctgaaacagttgcaaaacagcttcgattcggacatcgactttattccgtaccgtggagatttcgctcgtggtatcttcgcgacgctggtagtcaagaccaaagtagcgctggaagaaatcgttcgtatgtatgaggaatattatgcaaaagactcctttgtacacatcgtagacaagaatattgacttgaaacaagtcgttaatactaataagtgcctgatacatctggaaaaacatggtgataagctattgattatctcttgtatcgacaatttgctgaaaggcgccagtggacaagccgttcataatatgaacctgatgttcaatctggaagaaaccgtaggactacgtttgaagccttcagctttttaaaaacagaagaattatgaatttattcgacgtatatcctttatacaatatcaacattgtcaaaggtgatggctgtaaagtatgggataaaaacggaacggaatatctggacctctacggaggccatgccgttatctccatcggacatgcacatccccactatgtagcgatgatcagtaatcaggtggctaaacttggtttctactcaaactccgttatcaataagctccaacaagaggtagccgaacgactaggaaagatttccggttacgaagactacagcctgtttctgattaacagtggtgccgaagcaaacgagaatgctctgaaacttgcttctttccacaacggacgtactaagattgtatctttcaataaagcattccacggacggacgtctcttgcagtagaagcgactcacaatccttctattatcgctcctatcaacaataacggtcatgtcacctatctcccactcaacgatgtggaagcgatgaaacaggaattgtctaaaggagacacatgcgctgttatcattgaaggaatacaaggtgtaggcggtatcaagataccaaccaccgaatttatgcaggaactccgcaaagcttgcagcgaaacaggaacgatcctgattctcgatgaaattcagagcggatacggacgtagcggtaaattcttcgctcatcaatataatgacattaagccggatatcatcactgtagccaaaggaatcggtaacggctttccgatggcaggtgtcttaatcagcccgatgtttaaaccggtatatggccagttgggaactacttttggaggaaatcacctggcatgttcggcagctctcgctgtgatggatgtcattgaacaggaaaatctggtagaaaatgctaaggcaataggtgattacttactggaagagctgaaaaaattcccgcaaatcaaagaagtgcgcggacgcggactaatgatcggcctcgaatttgaagaaccgattaaggaactacgcagccgtctcatctatgacgagcatgtatttaccggagcaagcggcacgaatgtacttcgcctgttacctcctctctgtctcagcatggaggaagcgaaagagttcctcgcccggttcaaaaaagtactctaaccgctcatttgattaataaacagccaacaataaaagcagcctttattagaaatttatttcttattctggctgctttttgttttttcgtaattaactgttacctttgtctgtaacaactcattaaaaacaagcgtatatgaaaatagccattatcggtgcaggaaacatgggcggttcaatagcccgtggcctggcaaaaggaagtctgatagacgattcggatatcattgtatccaatcccagtgccggaaaactagagaaactgaaaaaagaatttccgtgtatctccaccaccaacaataatctggaagcagccacaggagcagacattgtcatccttgccgtcaaaccgtggtttatggaatcggtgatgcgcgagttgaaattaaaaagcaaacagatactcatctccgtagctgccggcatcagttttgaagaactggctcattatgtcgtagcaccggaaatgcccatgttccgtctgattccgaacaccgctatcagcgaactggaaagcatgacgcttgttgccgcgcgtaacacgaatgatgaacaagacaacttcatcctccggttatttagcgagatgggaacagtgatgcttatccccgaagataaaatagcggcagccaccgcattggcatcctgcggtatcgcttacgtactgaaatacattcaggcagccatgcaagccggaatcgaaatgggactccgccctaaagatgccatgcagatgatagcccaatccttaaaaggagcggccgcactgattcagaacaacgacacccaccccagcgtagaaatcgacaaagtaaccactccgggcggaatcaccatcaagggtatcaatgaattagaacacaacggcttcacctctgctattatcaaagccatgaaagcttccaaataacaccatagaattattaatcataaaatactaaccatttgtatgaatgaacaaattaaacagatagcggaacgcctccgcggattacgtgatgtattggaactgaccgcagaggatatcgcccgcgatagtgacatttctgctgaagaataccggcttgcggaaactggagattacgacatctctgtcagcatgttacaaaaaatagcccgtacgtataatgtagccctcgacgctctgatgtttggcgaagaacctaaaatgagcagctactttgtgactcgtgccggcaaaggtatcagcatcgaacgtaccaaagcttataaataccagtcactggcttcaggattcatgaaccgtaccgccgatccgttcatcgttaccgttgaaccgaaagcaatcgacgagccgatccattataacaaacataatggacaggaattcaaccttgtcatcgaaggacgtatgcttatcaacatcgaaggcaaagaaatcatcctcaatcaaggagacagtatttattttaactctaaacttccacatggcatgaaagcgctcgatggcaaaacggtacgttttctggcagtaattatgtaacaacatcatggtagaaagatttttatcacagacctctttcagctcacaagaggacttcaacaagaatttaaaaataaacgtcccggagaacttcaacttcggttatgacgtagtagatgcctgggcagccgaacaacccgacaagaaggctttactttggacaaatgacaaaggtgaaagccgccaattttcatttgccgaaatgaagcgttacacagatatgaccgcatcttacttccaaagtctgggtatcggtcgtggggacatggtgatgctgattctgaaacgccgttatgagttctggtatagcaccatcgcccttcacaaactgggagcaaccgtcattccggccacccacttgctgaccaaaaaagatattatctatcgctgcaacgctgccgatatcaaaatgatcgtagctgccggtgaaggaatcatcctgcaacatatcaaagatgctctccccgagtgtcccactgtagaaaagttggtcagtgtcggaccggaaataccggaaggtttcgaagatttccatcagggcatcgaaaatgccgctccgtttgtacgtccacgccatgcgaacactaacgacgacatctctctgatgtattttacttccggcactaccggcgaacctaagatggtggcacatgactttacttatccgttaggtcatatcgttaccggtagtttttggcacaacctgaacgagaacagtcttcacctcaccattgccgataccggctggggaaaagcagtatggggcaaactttacggacaatggattgccggagcgaacatcttcgtttacgatcatgagaaatttaccccggcagctattctggaaaaaatccaggaatatcatgtcacttctctctgtgcacctcctaccatcttccggttcctgattcacgaagacctgacaaaattcgatttatcttcactcaaatactgcaccattgctggagaagcattaaaccctgccgtatttgaaacattcaagaaactgacaggtatcaaactgatggaaggtttcggacaaacagaaacaacccttaccattgccaccatgccttggatggaaccgaaaccgggaagcatgggacttccgaatcctcaatatgacgtagatttgattgaccatgaaggccgttccgttgaagccggggagcaaggacaaattgtgatccgtaccagcaaaggtaaacctctcggacttttcaaagaatattaccgggatgcggaacgcactcacgaagcttggcacgatggtatttattataccggtgacgttgcctggaaagacgaagacggttacctttggttcgtcggtcgtgcagacgacgttatcaagagctccggttaccgcatcggtccattcgaagtggaaagtgcattaatgactcatccggctgttgtggaatgtgccattaccggagtacccgacgagattcgtggtcaggtggtaaaagctacgattgttctatccaaagactataaagcacgtgccggagaagaactgattaaggaattgcagaatcatgtaaagaaagtgactgctccttataaatatccacgtgtcatcgagtttgtagaagagcttcctaagacaatcagcggtaagatccgccgggtggagattcgcgaaaacgataagaagtaaattataaacaactctaatcaatagaagaacgatattacagatgatgtaatatcgttcttctcatatctacccaacaataaaattcaacagaaataatatgatagttcctgtttatttaaaactctcttttttccaataattatgtccttcaataatatgactgttattagctttataaaaatccttcacaggagtcatctgaaaacaattattaataatagcattatcgacatcttcaaaagtaacaatcggttgttggtttacaggatacttcgatctaacattattcagaacaatctgcttacacttactgaattgccacggtgaaccagtctgcgaagagaaatccacattatcaaaacgaatatcctcagcaatatcaactataaatccaacctctgccttcatattaatatttgaaaaggacaaaccttgtacaggcatttcttcaatccctttaatataaccaatttgcttgatatcagaacctgtgatattactcaaatgaatgttccggaaaacaggagtccgttcactgacaggttccacttttgattctttatcatagaacaaatcaaagatgaaggcattccgctgaatattcttcatgacgatattatctacccgaagctcttcaacaactcctcctctcccacgagaagatttcaagcgaataccggaatccgtaccatcgaaaacacaattagaaattgtcactctccttacaccgcctgacatttcactaccaataactacccctccatgaccggaaagcataacacaattagttatcgttatattttcacatgcctttccatatttccgtccatcagcatcacgccccgatttaattgtaatacaatcatcccccacactaataaaacaatcagaaatacgcacattccggcaagaagaagggtttattccatccgtattgggaccttttgggtcttttgaagggttatatatcgtcactccatgcactgttacattatcacaaaaagccggatttatggtccaaaaaggagaattgacaattttcacattctctatcaacacattgttacattcataaaactgaataaaaggaggccgaaacatacgacgctctaaagaaggtttataataatccgaaatttccagatcttcattagcctcttcccacattcgttgtagtttattcaaagcaggcaattttcctccgttctttttaatcagctcccgtgtttctttctcccagctccaccatttgaatccattaccgttcaacgttccacgcccggttatagtcaaattctccgcatcatgcgcataaatcaggggagacaaagtattcatcactgtaccttcccaacgaatcttcacaaaaggaagataatcttcaaaacgatctgaaaaacgaagaacagctccggactccacatacaaagttatattacttttcatgtggatagtggctgtcaaataaacacctgccgggaaataaatagttcctccaccttcagaagatgctttttcaatcgtttggtttattaactccgtacaagattcaatacctcggggatcagctccaagctccttcatattaaaggtacgagaccatgcggttacggctataacaagtcccactacacaaataaatagacgtttcatttatagttttcatttaaaattttaccagttctaattgtcaaaacaaaagtacgaggtatcttctctccttatagggtaataattgtgcttgatagaggatagacaggtggattaaatatgcaaaagcgtgcattttatgttcaatcacggttttatatttcctttttaatccagttttatctatttttgctctacacataatttataatatcatgaagacactctatgttttccttttatgcttatacaccagtctgactgtagcagctcaacctctttgccagattaaacacttctctgtcaatagtggcctttcgcaaggagtagtagtgaatataatgcaagacaaaaaaggatttctttggttcgccacctggaatggactgaacaaattcgacggatacacatttaaaaattacaaagcatttccgggagacggctgtactttaacgactaaccgtttctcttatattacagaaagcaaagacggagatatatggtgcaaatcttatgataaccgtgcatatctatttgatattcagacagagaagtttattgacatactccttcctattgaatcatccctgcaacagaccaacacagtcagcaatatctataccttaaataaagggattacatggatcacctgcgaacaaggttatgctttcagaatcaatgagcaaacctgcaaagaaggaaaagatatcattttatacagcagtttcaaccaaaatttaaaaggaaacaagatattcgacatttacgaagattccgacggggacgaatggatcatgacagataagggagtaaccatcatcgggaaaaaacgaatcaacagcgattatccgttcaaaatggtcaaagaatataataagagaatatatcttatctcaacttccggaaaaatcgcaatatatgatcccaagaacggaaatataaaattccaggagttaccatgtcctgtcacagatatctattccatatcttccatttccccttctaatgacaagatcggcttaggaactgacaacggatttataacatacgatacagaaaagaaaaaattccaacattttaatatacaaacagccacccagccatccaatgaagctcatttcttttatcaggacaaaaccggagaagtctggatctttgccaatacctccggtgtgataaagctaaatctgaaaacaggagataagcagcacttcacagctcctatacaaaacctaatccaatatgaacgcgacaaccggtacatgatctttgaagaccatgaaggcacactatggatgagtcctcaaaaagggcatttgtgctattatgaccgcgacagtaatcaactgaaactatactttgcagatgaaaataatcccgcttccctatttgccccctctattcgctattattataccgaccggcaacagaatgtatggattaccaatgaccggggcgtagacaaaatatctttctatcccaataaatacagaatacgtcccatagacaatggattggaaatacgtgcttttcttgccgacaaacagaaacgtctctgggttgcttccaaaaagggaaacgtcagaatttaccgtccggatgggacattagaaggctacctttctccacagggcataatcacccctcaagaggttactttcggaaaaagtgtgtactgttttatggaagataaacaaggaaatatatggatgggaaccaaaaaagacggcctcatccttctaaagaagaaaaatgagcactcctatcttttacaacaattcgtccatcagccacaagatacatacagtttaagcaacaatagtgtctatagtattattcaggatagtcatgacaatatatggatcgcatgttatggaggtggcctcaacctattatcacacgcacctgatggttctaccaactttatccatagcggcaaccggctgaaaaactatcctgtttctacttcactcaaaataagacatatcgcagaagcccccaacggagtgttattgattggcacaaccaatggtttacttacattctccaataagttcgatcagcctgaagaaattaagttctatcacagcaaccgtatccctaatgtagattccagccttagcagtaatgatgtcatgcagatatttactgacagtcgaaaaaacacttatgtaataacattcaccggaggaatcagccaggttatctctaaaaatctgctcacggaagatatacaattcaaaagttatacaatcaaagacggattagcttccgatttggtactttcaatgctcgaagatactcaaaaacaattatgggtaatctccgaaaactccatatccaaattcaatccacaacaaggaacatttgagaattatggaagtaattactttcagagagaactgaatctcactgaagcagttcccacactaaccagtcaaaagaaaatcgttctcggaaccaatcaagggatacttgaaatcaacacagaacaaatgaaaaaaagttcttatgtacctcctattgtatttaccggactcaaaatacaaggaagtcaacttcatgtagcgcttgatgacataaaagaactggaactaaatccttcggaacgtaatgtcacctttcaatttgcagccattgattatgtaaatcccgatgccatcgaatacgcctatcgcctgcaaggcctggaagaagaatggaacgaagccggtaataaccgctctgcaacatacataaatttacctgccggagaatatcaactgcaaatccgttccagcaatagcgacggagtatggaccgataatatacgcactctccccattcatgttttacccactttttgggaaacatactgggcatggttattctatattgtcatgttcgttttattcaccactatcattgtatacatcctgttctatatctaccgtttgcggcatcaggttgatctggaacaacatttatccaatatcaaactgcgtttcttcactgatatttcacatgaattacgcactcctttaactttaatatccagccctgtatcagaaattctagcgcatgaagcaatctctccgacagttcgggaacatctaaatttggtacataaaaacacagaacgtatgcttcgtctggttaatcaactactggatttccgcaaaatccaaaataagaagatgaaagtgttggtagaaaagacagaactcgtttcccaattacagaagataatggaaagcttccaccttatagcaaaagaaaagagaattgatttccaacttcaaactaatacagacaaaatatacgcatgggtagaccgtgacaaatttgaaaagatattcttcaatctactttcaaatgccttcaaatatacaccgaacgggaagaaagtaacggtaaatatgataacaggttcggagcaagtcaccatctccgtatctgatgaaggcattggcattgctcccgaaaagcaacaatccctattttatcgatttgaaacactggcacaatacaatatcctgcagccctcatccggcattgggctttcactagtacgcgaattaatagaattacatcacggaaatatccaagtgaaaagcgagccgggaagtggaagtgaattcattgtcacacttcctaaggaagaaaaagcatttgcagacgatcaacaaaccgaatttattttatccgacagtgacaataattcaccgacgatacaagctactgaagaagattcggatagtacatccttcaaggcagcatacgcagagaatgaaaataaaaccgacgcagaggatgaaaaaacttccattcttattgtcgaagacaacaatgaattacgtcatttcctatggaatatcctgtcagagacttacactgttctcgaagcaacaaatggaaaagaaggattaaaatatgcacagcagtacattccggatctgataatcagtgatgttatgatgccggtcatggatggattagacatggtgaaagcaatcaaagccgatcatgacacctgccatattcctattatattactatcagcaaaatcttctttagatgatcggatagcaggactggaacaaggtatcgatgactacattaccaaaccattcagctctacatacttaaaaaccagaatcttgtcgctgctccgtcagcgtaaacagctacaagatctatatttatcgaaactgtcagagcatactcaagaagaggatcatataaatgggtgggagccttcacaacctcaagtgactccatacgatgaacaattcatgcaacaagtaatggcgtttatggaggaacaaatggataatacagatatcaccatcgacgacttcgccaacaaactaatgttaagccgtacggtattctaccgaaaattaaaatccattgttgggctgactccggtagatttcgtatgtgaaatgcgcatcaaacgagccgcccagctaattgaaaaaagtgaatacagtttctcccaaattgcttatatgaccggtttcaatgacccgaagtactttagcaggcgcttcaaaaaaatcatgggagtcactcctacagaatataaagaaagaaagggagatgcctcataagcacctcccctttccttaccagttttctatattcaattacaatacaccttttttaccttgcgttccatattgattcacggcagataccttcaaagcataattcacttccgacaccggaaaagaggtatcagtagtcgtcccgagaatctgttctccatcatatacaatatatccgatcgcattcttcacaggattccatttaagagtgccttgctgataaaccagactgcgcggacttcctaatttctccatcataatacgcggattccagccatcattacccggaatcatattttcgtacgtatatttgtccgcctcctctttcgttatagttgcctgacaggtacccgatacttccttaccggtttggcggtctttatattgatattccgttttgcgtttacttaaatccaacacattaccctgtgcatcacgactattgtattcggcaaaaattccgggaaccgttcccatattcgtccatccttcatcagcgacagggataagcatgatggtattgatatacaccgtcttcgaattattatgccatggacgccccaacttcaaacgtccgtcagccgcttcactgtttccatctatagtgcaattacgaaaagcataaccatatttagcatctttatgggaaggagccactattactgctccactccgtacattataaagcgtacagttttccagcaacacatcaccaccaccataaaaatagtctaccgcgccttctatccagcaatctttcacatagtgccgactgacatcattattggcagtcatccaagtatcttgaaaagaacggaacttacaattataaaaggaagcacaatctgcctgactattcatagccaaagcctgcggaccattatctgataaaactccccagtcattcacatacgaaatgttttccgtataaaagtggtctccttttaccaccactaccgatccctcgtatttataaactggagaggaaggattatgaaccgagtgttcccaataagctgtttttccacctatttctttaccggtcagtttactaccaacattcaagtttaaatgaataatggtcttatccttatcctggcctattaaatgtacgtatggcttattcttagggataatcacctgctcattatacaagccattctttatcagaatcaaccaaggtttcgtctgtccgtcaggtacagcattgattgcttcctgaaccgttttataatctccactaccatcaacagctacaatagcctgataaggcgatgagtccgcctgtgcataaatcattgcacaggcactcatcaataaaattgataatacaatattcttcatgatattctttatacctaacaagtataggatcaattaataccaacgtggatcaccagcattacccgttccggcgaacccggctcccggtttaatatggaaatcaccgttcaatggatcaacgaacaagtcatccgagctttgttttattctcgttatttcttcaaacctgttattgccttcctgcaggtcggaggtgatataacaattatcagagaagttcaaaatgtcataagcaccatttccactattcattttctttcctttgttcggaccggagaaaatcaaattccgcattgtcgcagatttcggagaaggcggagtacttgccgcattatcgaaacggaaaactttaggcaattccttcttagcatccatagaattatagaaagtacaattttccaatatcacatcaccgattccccctttcacgtccatcaactggtcaccaatattaatcaatgtactattcgttatagaaaccttttccaactgatcgatattttttccgaaattaatcattccatatccgtccgtaccaacttcggatatgacacagttatcaatcgtaatatccgtcatgaacacaccacttccatcgctaatacgtacaagcgtacgttttatgttctgtatagcacatcctgtaaatgaaatagactgggcataagaactatttttccaatccgtcatataactggcctcgccatttccattcaggcaaacaaactcgaatgacagagactgtatcggagaagccaatgatattttattagtcacaataagctgtggacgattattttcattagcttccgtactggtaaacaaaatattatccaatcccggaatctttagttcacttaccttatacaccgcccccggagtaagttggacagttacattgctacattctttctctttcacaaaattagataacaatgtacttaaatcaatgactccggtttccgtagcctccacaaaaaggatttcgctaccacccaatcccagtgtcttgaatacatacgaaccacgtaatgcatcattattataaatccgaacacgataggtcgctccattctccaattcggagagtgtttttgaacaagccgctatatcttccgaagtcaaatcaatctgtttttcctcaccatatttcgtatccaccatttgagccaacgtcagatgagttaccctgttcgtttcttcccatgtcaaggttgcggaattagctgtaacttccactccggtaaataattgctcatccggagttttaaatgctacactgacataagtgcttgcctttccctgcgcatcttctcctttcatacgaacagaatattgcgtagaaccgttgaactcctgaaacaaagtacgatattccaccctcataggcgtattactctctgaaaatacagtcaatgtatctttcagaatcgtatctgtccttacataattttccgcattaaactccaagctgtccgtataaaactcaaaaatatagacttttgcattcacaatctgcgaatatcttaatgtaaccgaagtcgcatcggtagccgacttatcgaacgtcaacggacggaacaaagcatcatagttcttattaactgtccagtcattggcatcgtcctcacaggaagacatacccactatcaaagccaatagtacatacaggcatgctccggataatctattaactagtcttttcatcttttcctaccattaattatttataaccatacgaattagaaacatacccttgcgtcttattgacatcctcataataaatagcgaatacatggcgataattacacactccattaccaacagaatatttacggaactccgcttcggcttcaccgccccagttcagcctgccaaacaaattcgaatagtcgtaagacgcattcagccctgtaccgcaaaccaatattctagccattgttttcacataattagtattcagggttgcatttatatcaccatccttattcaatgtcacctgcatactgatccagttgcactcatactgtccttttgatgcagaagcagtaccggttcccatatcctcattgaagttaacagacgacatatcaatgtattccggattatcagagtcttcatatttataatagatttttctcggtatttcatccacttgataagtcttcccgaaaatagtcaccggcttgtagtcatacaacatacaaagacctattttcatctcttctattttctccgccaacaatccccaacgtgtcaaatcctgacgacgaatagattcacatccaaactcccatgcccgttcattgacaatagccgtgaagaaatccgcgtcatactgcgtgatttcgggagcaccagtaccaaatgctctttcacgaaccttttccaaagcctgtcggggagacataccggcaatcggactaactgcatccggtcctgtcaatacattttgagcctccgcaaacatcaggtaaatatctgaataccgcatcaaaatccagttgataccagtagcaatacgtgaattagctttcgggaaacggactttcatataattatcagtcatccaataccaacgccatttaccacaagccactcctaatggattacagcgaataacttccttattttttccattctcattgatatattcctggaaaacacaagtaacatcccgacgggtgtctgccggatcaaatgaataaaaatagtaagcagtagtagccgcatatcctgcccctcccataccttgggtggtattaaaaacccctctgttcaggttgtatcccatcgtggcccccacatctccattctgtccttcaccaaaagcaacttcaaacaggttttcattatacttgttgtattccagatgattgacagtagaccaaatattctcataactgggatcaagctcatgaggattatcagtcgctcccaaaatctccgcacactgtttggcagccagttcataataatctttccaattcttagggcgaccgacgaaatatccgttcatttccggaatggtcggatgatgttccacatccaagtccggaaactgatttccatcccgtacagaccatcctccagcaaatagcgctacctttgccagcagtcctttggcaaaacctttattcatgcgttctaccgtatatgattcttctcccatccaaggcagatattcaattgcctctttcaaatcctctatgatataattataaacaatatcacgatccacttttcctatatagacatttcccaatccgctttcagacgcatgctctttatatggcacatctccccaataacggatcaattcaaaatagcctaacgcttttagtgctaatgcctctcctaaatatctacgcatggcagccttgtccgaagtagattgcatcaacggtgaccgacgtataccatctacgatagtagtggcggattctgccagataataaagtttgtcccatctggtattccggttataattatcgtcataaaaattgccagcaccttcatcacgaagtgtcgaattatagttttccgtagaaaacgcacccgagccaacctccacgtcagaagctccctgccagttgacacacagtttctgaccatatatataggtgtccgtcattgtcgcatatacacccatcagggctgcttccgtcagagctgtcgatttaaacagattctcatcacttggaatagaaggactttcggtatccaaaaaattatccatacacgaagtgcataacacagaggaggataaaaccgctaaaaatagtttctgtattttcatttttcaagtattaaaaagtaacattaagaccgaatacataagaatgtgctttcggatatgcagaataatccacacccggagtcaaaggggtagaacgttgtgtgctcacttcaggatcctgtccggaataagctgtccagcaaaacaggttattggccgtagcatacacgcgcaggttcttgactcctagcttacgagtcacagtaaccggaagcgtataccctaacgtcaggttactacaacgcaaaaaagagccgtcttcaatcgcccagtccgtcacaagcgtacgtcccatcataggcatccagatagaggctttggaattgatttcaacaaagcgttccggattggcgtcattaccatacattacattggcacccgtttccggatcaataatcgaccaacggttttccaaactcataaaatctctgatattattatatttacgattcgtatgagtggatgccataatcttattggcattatatactttattgccatatgaccagttgaacattgccgcaaagtcaaaccctctccatgcagcattcagcccgaatccgccaatatgctttggctgtacactaccgatcactttacggtcattatccgcatcgatcacaccgtcattattctgatccttcagtttgataaagccaggaccaaagttaggcaggtcattagagaacaaagccctgtcgtctactaccccttcattcagtatccattttttcgtattctcatcaaacgtaaagtcgtctacagaataaaagccctctacttcgaaaccataaatctgtcctaccgcctgacctacaatagcacgaaaatcatcagagccgatatccggtcgccagttggattgcgcactcaatacggttgccgttccatccagtttattcactatatttttattgaatgatatattgaagttagcgcccagatagaaatctttactattgataatcgttccgctaagcgtaagttcaactcccctgttcgtactgcggcctacattctgatactgatattcatatcccgaatttgaaggaagatccatgcgtaagattaaatctttcgttatatcattatagaagtcaaccgtcacattcaaacggctattaaagaggctggcatctattcccacattagaggataacttcgtctcccaagtcagattctcgttccgcaaggtgttctgcaatttcagggcactctgtactgtttcattcagataatattgcctattggcagaagattccattttataatcctgtctccagtatgaattgacacgcgcattaccaactgacccgtaactcacacgaagtttcagattatccagccagtcttccgtctgcttcataaatttttcctgggaaatgcgccatgccaatgccatacccgggaaaaatccccaacggttttcaggagcgaacacattcgttccgtcggcacgggctgtaaaagtgaacatgtaccggtctttgaaagcatagtttaaacgaccgaagtaagatgccgtacgggaaggttcaccaagagtggtatacgttggttgggattctccatagttccacatagccaacacttcgctcgccgtaaaatccataggataatatttggatgaggcaatcatctgatttctgtaattactcaccatttcatgtccggccatcagatcaaggcggtgattctttttcagagagaaccggtaactcaatatgttctgcaagttccatcgtgcacctttctcatccgtacgtttggctacgggctgaccagcgttggaactcgactctccggttttctttagccagacattatcggtataattataagtatatgcgtaactacctttcagctgataagtcaatcctttaacaatttcccagttaaagccggcattataagtcatagaaaactggttttgcttcttatactcattcaccgtattatatacaggatcattcaatgatgataacaatgcatcatccgagtaatcaatttcaccccccaaagcatctcccgcatctatacttgcaaggctgttgattggcgagaaaagaacggcatctctcaatttacctccattggtacccgcaccgtcaatcaccattctagtcaaacggctggaaaactcaaacttcaatttgttactcaactttttatccatcttcacactcaagttatccctcacataattggagttgagcataatgtacttctcatcatcccgcgtataactcaaattataacgcaatgtagcatccgttcctcctgttataccaacgttatagctttgtttgaatccggtgtttccatatactttatcctgccagttcgtgccttctaccgaacgataaatattgcggtcgtcccaacgtccatacatcgaattaatgctactggtcagagaggtgcccggatcaagctctttctgaaaacagtagtattcgtaaggtgaaagtacccccgtcagattatacacattactgacaccccagtgagcattgaatgagacttctgtttttcccgccttaccgctttttgtagtaacaagaataacgccgttcgcacctttagctccataaatggcggtagaagaagcatctttcaaaacatcaatgctctgaatatcaccgggaggaatatcattgatattactcacctgaaaaccgtcaacaatatataacggtgaattgtcctgggtaatagaaccaccgccacgcactgtaatctggattgttgcatcgggcgatccatcagtagccactacattcacacctgccagttttcctgtaatagccgcagccgcagaagttatcggaatatccttcaaaaccttctcactcactgaagaaatcgcaccggtcaaatctccgcgacgtgaggttccgtatcctaccactaccacttcgtccaaagtctgattgtcttcttccaacacaactttcagatgtttgcccggtttcacagtcgcaacaactgatttcattcctacaaaactaatttccaactttgttgcatcttcgggaacagacaaagtgaaatttccatccaagtcggtaattgtaccgacggaggactttttcaacaccttcacactagcaccaataatagcatcgccgttggtatccaccaccgttcctttcacagataccttctgtgcatatactgttgtcgccgttataaagcacaagagcaagcaacatatatacgcaaagcatcttctcaaaaataaatgtctttgtacatccatagtattatcttgattaatttgtttcatttttgatgttacaaaagtcacacttttacatctgttttccactcattatttatgcaaaagcgtggactttttatatagaatgtcttattttactgtaacaataatcacctctccttcgcgtgtatccacatcatacaaataagtatcacgtaatgccactccttttaaaggcgctttttcactaatcatcgggcgtgagatttgctgtactttaaataatgcgttcggattcgcttcctcttccttcttctgtttcaacaatgctccttcagcagccaatttccagtaagagcgcaggcgcagattgcctccggtttccgaacgtaacacagcttttaccagcttaccgtccttccaagtcaattcatcaatcaaaaaacctccccgggcacgcaaccctttcactgtcccgctcttccattccgaaggcaatgaaggcaacagatgaatcgcaccatcatgactttgcaccagcatttcggcaataccagccgtgcaaccgaagttaccatctatttggaaaggtggatgcgcgtcgaataaattaggatacgttccgcctccctgtcctttttgtatttcagggctgacataagtcagctgattctttatcaactgataagcatgatccccgtcaagcatacgggcccagaaacaaactttccatcccattgaccaaccggtagaaggatctccccgttgtatcaatgtgttttttgccgcttcaaagagtaccggagaacgataaggagaaatctgataaccgggatatagcccccaaagatgagagatgtgccggtgacgatcattaggatgatcccagtcttcaaaccattcctgcaattgtccgtactgccctacctgcatcggaggcaactgccggcgcatattcttcaatgtatcacaaaaatcagtatctgcgttcagcactttggcagcttcgcatgtatttgaaaataaatcaaaaaccaactgattatccatcgtgattcctgcaaaaagattacttttcttctttatccagcgcggagaattctcgggtgagttggaaggagtgacaaccagataacccgtgttcgggtcgcgtaccagaaagtcgacaaagaattccgaagcacttttcatcatcggatatacttcctccaaatacttcttatcaccggaaaacaaataacggtcccataaatgctggcaaagccatgcattagccacaggccatgtcccacaataaggacggtccaccgcacccgtcatacgccacaaatccgtattatgatgcaacacccagccacgacaaccatacattcgactggcagcttcacgcccattctcgctcaattcacgtaccatctggatgaatggtttatgaagttcggccaagttggtgatttccgccggccagtaattcatttcagcattaatattcgttgtataattgcagctccagggaggtcccgggttatgattccatttgccctgcaagttggcgggctggcatccgggctgtgaagatgaaatcaataagtaacgtccatactggaaatacaatgctatcaatgccggatcataggatgaagaaaattccttgatacgtacatccatcggcttattggcttgggaagtttcacccaaatccaaagttacacgattgaattgtttctgataagcagcaatatgagcggctttcgctttactataatctttcgctgcatttttcaaataagctttattccgttgatacggatcgcccgatatatctttatagttgacaaagttagtcgccatcgagatatacaatgtaagttcactggctccttgaacgctaagcaacgtgtcattggcagttatcactttcccacctttatgtttcacatccaaatcggcacaatagtgcactttacccggaaaataacggctgccatgcgtaataccttccagccgcaaacctttctttccataaatactacgtttcggatctctcatcggggtattaaaaaacagttcgcaattgattgttcccggtttggatgctttgatatgcctgataaccagttgatcggtaaatgatgcaaatgtttcttcggtaaattccactccgtctacttcgtagcgagtcacagctactgcattgcttatatccagatcacgatagtaattatttacctttttgtgatcttgataacgaatattcagacgacccactgtctggtaaggcatttcattccccacttgtgaaagaatcttcgttgccgccatgttctgcgcttcttcgtactttccttcaaaaatcaaccggcgcatttccggcaaagccgtttttgcttcttcattatagttctggtaaggagagcccgccgacactgtttcttcgttcaactgtatttgttccagttgagggtcaccgaacaccattgctgcaatccgtccattaccaaccgggagtgcttcttcccaataagaagcgggtttgtcataccatattctatagatgttttgtccttccacattccccaacagagaagaaaaagccaacatacaactgaatactttacttatcattttcatattttaaagttttaattgtcatcactcttttgaaggttcactcaaagacccatactcactaacggccttcacctgatatgtctttccttcctcaacattacaagacgtttccttggttatttgtacagtttcatcgttcgcaattaccaaataacaaattgcatattttgaagcatcccaacttaatattccgttttctcttttcagattttccggtgcggatatttgttccatatatttcttcgggtcccaattatcgccctcacgaacaacgttttcatacgtataccgagctgcttcacctgccgtaaggacagcctgacaaatgcctgtcaccggattctcttgttcatcctgataggtatattgcgttttacgctggcttaaatctacagtattcccctccttatctttactgttatattcagcaaacatttgaggaatagctcccatatccgtccatccttccggagctatctttatattaaaaatcgtattgagatatacagttatcggagaattgtgccagggacgccccaacttgacactttctgtatcagccaattcatttccatccacaatgcaattattcaacacatatccccaacgtgttcctactttatgagaaggagcaacaataattgcgccatccctcatattataaaaggtgcaatgttcgagaaagcaattcccgtttccatagaagtaatcaacggctccttcaatccagcaattctgtgcatacagtctgccgttatccgatttaggcccggtctgccaggtgtcttggtacgagaggaatttgcaattattgaatgagttgcggtcattctgggtatacattgccaatgccatagggcctttctgtaattctttgccatatccgtttacaaaagatatattctctgcgtaaaaatccgtagccttcactgataccatagcggcttccgtttttcctaagttcttataagagtacttccacacatccggatcagtcgcactggcttcggttgagctgttaattcgtaacttgacaattgtcttatccacatcctgtccgatgagatgaatatacggtttgtcttcaggaatgattatttgttcttcatacgttccgttcgccacgaaaataagccaaggttctgttcttttcgaggggacattatctattgctttctgtatactggtatagtttccttttccgtcaggactgaccaccgcatcaaatatgcgtgcttccggttgaggacgttctctgattgtaaactgaatactaacaccttcgaatacatttccctgaaagtctatgactgcacctttggggaggctgaactgacagacctgattatagtccaaagcagtataagcgtaagacgctgttttacctttgaaagtcaactccacttcctcgccattaaaattcgctttcccttctcccgctttcacatactcgttaaaagtaagcagaatcgtattgttttcttcggccgtttcaccatttgcaggagttacagacaccaaagaaggggcttcatggtcgggaacaaaaaagttattgctactttccttgcaacttgttgccagcaaagctgataacaacaatagtccttgggacatctttgaaaataaatgtgctttcataaattatttgttatattcttaatgatagattcttattccattattatttggtcgtcctgtcttgagcagttactatttcacgttacaaaagtatacggaacaacatgaatactttctcactatttgtttgtttgcgtggactttttttaatatcattcaaaagttgcggactttttgtgcaatctggtgcactatctatgcaaccagttgtctatcaaattctatccgcttacatttgtatcagtatcactatcatcacactttataaaaaatcaggtaagatatgaaaaacaacaaggtaaaattcattttcgtggcactactgtttgccacacaagtagaagcgttctcctcctgttccacatcttcagtcaatgaagaaaataaagaacaggagactccaccggattctccctccgtatctccaccagtggaagaaacagcatatgcctttcccggagctgaaggaggaggaatgaacactacaggaggaagaggtggaaaggtatatattgtcagatccctggaagactccaaagcaccgggtaccctccggtatgccatcgaacaaaaggagcctcgtataattgtcttctgtatatccggcaccatttatctaaaatcgacactggacattcggaacggtgatgtcacgatagccggacagacagctcccggagacggtatctgcctggctcactttccagtaaatgtatcggccgataatgtaattctacgatacctgcgtttccgaatgggagatacggatttgctgggctcttcggcttccgacggtgcagatgctctgggaggacgccagaaaaacaatatcatgattgaccattgttccatcagttggagcactgacgaatgtgcttcattctatgataatactaactttactatgcaatggtgtattatttcagaaagtctccgcttatcgggacataccaaaggccctcatggatatggcggtatttggggaggagtcaacgcttcctatcatcataatctgatggcacaccatgacagtcgcacaccacgtttcggttccggagtaaaatatcaaggtcaggaacgtactgatatgcgtaataatgttatttataactggagcggtaacggatgttatggcggcgcagcaatgggtattaacattgtggacaactactacaaacccggacccgctacggatgccaaagtggccaaccgtgtgatggctatcgacatcagctcttctgatggagattttgcaccgatcaaaggggtattgggacagtatcatatcagccggaattacttcgaggcaggaaaccaactgacagaagcatccgccgcaaaagtgaacaaagacaactggactggtatccgtaacaacaccggtcactctctcgatgaactgaaacgggatactccggtagaagtagatgcggtaactacccacacggcacaaaaagcttacgagctggtgttgaaatatgcgggttgcagtctcaaacgagatgatatagatactcgtatcgttgaagagacacgcacaggaacggcacaattcatcggaaagaacgaacacaacggattaggagatgccccctgcccgaacggtccttgtgaacattgcgacaaaggtatcatccattggaaaagtcagaattatcctaagggcggacttatcgatagtcagaaagacctaaagccttccggagctggtagcgactggagcgcatggccaacattaaaatcattgccacaaattactgattctgacaatgacggcatgcctgacgaatgggaaaccgccaacggattgaacccaaacaaatatgatgcaaacggaagaaatctaagtactgcctatgataatatagaggtttatatcaatagccttgtagaaacaataacaaatacgcaaaataagaaatgaatgatgtgagggaaaacaactcttattaacgcaaaaaactggtcaattaatacaaatcctgattcaatgaatcatttgtatactatatatgaaacaatattgcacctctatgttgcttttctctcttatctttgtcgcagtaaaaacaaaaacacactataaagatcatgattacaagtagaaagatttctcaagtcaaagtttttgctggtagtccttgggaggtagccagcgtaaagagtttgttgaatgcagcttatattcaagtgtcaacgaaagacaatggtttaaacagtattttgatttctgttccttgcgaatactatactgcggccatgcgtgtaattaataacagaaaagtttcataggttttaggtttacatataaattggagggttcttattgtcagcaggagttttggctggataatacggtgactagcaactcattgccccctgacaataagctatgacaataggctgacaataaaaagatcgtacttttattgtcagcctgttatttaatagataaattcacagcagaattatagaattcgtttcaatctcctgcatatctttctgatccagcagttgctacaaatagcgttgtccgacatagaattcttctcgaaggatcgcagtctttcgtattgttcctccaccattttccataaaccgtccagtcgcgaactttgtcctctaattgccattaattcctgatcccgcatattcaagagtgaagcatacaatcggctggttttgtttttttccatgcaaagttgctctaattcatcgatatattcagacgtaattcccagcttagtccgttttatgaattgctggatactatcatcatctatggaaactgtatcgttctcataagacactgtgatttttttcatttccacccagagccagatatactctttttcgagtcggtatttctcggctgccgcttctatgctaatccattgtgacatagtgtttgtttttaatttgttatacaacaaggaataaatagcactctattgatgttgattcaacaaacattcgcgctttttgtattccgggcggacaggagattagagttggggatttataaggatcatgaaaccaaccgggtacaagaaaagcgtgaatgctgttgaatcattatccgtatttgaggcctagcaaacccgtccgaaagataatgataacaacagacatccacgctaattgtgtatatataacacatctttcatcgatatgttgacatacggccgttcacgtggaatatctgttgaaccacccctctacggacagaaacttgctagatttcaaatacgagggataatgcaataatattcctatttataaataaaaaacgcttcttacctgttttcaccacgctggtgaacagaaagcgtatgacaaagatatgcttttttttcgaaacaaagtggaaatacggaaataaatacaggaagttttgtattgaaagagaggaagttcaatattagcaaagagcctataagaaatataaactcgctacgaagcgaatgtcgccccgttaaatgagtactgcacatccggtatctttcactaaagaagcaggtattgttctgctaaagtaacagtattgttccgttaaagcagcagcattgttcggctaaagcagcagtattgttcagctaaagtaccggtatctttacctttccacggccgtggtgacttctttccacagccgtgacgaattcctaccacggccgtgggaagatctcgtcacggccgtggcgaactaccaataccggtaagttaacgtaagaataacggtgtctttatgcaacaatacacagtggcgagcatatctttacttgcttgttaatgtttcaagtccgccttcttgaatagagtataacaagaaagcacattctttatcgcgataaagcgcaaatagtttgttttacatgtaccttatccgtacctttgaaaccaataacaaacacttactctcattaaatatcaagagaagaaaaatgaagattacacaaatcagggaaaacggagatacggaggcactaagcgtgacagacatcgacctgctgatagaaaaaatgaaaaaagaaaccaagctccgcccggtaaccggattacgtcaggccctgcattttgttctacccgacgagccttgttccctcgccaacaaactaccacgagtgattcccgcagcagccttcgaacgagtgaacggagtgaaacgaatgaaaacctacaatggcattgtagaactgaccatcggtccgctagccggaaagacagaagtggaaatcgtgaaacaaaaggcagccgaacttccccaaacaatgctggcttttatgggtgcaagtggtaaaagcgtcaagatatggacttgcttcacccgtccggacggcactttaccgcaaacaacggaagaagccgaagtgtttcaggcacatgcttaccggcttgccatcaaatgttatcagcctcaacttcccttcaacattctattgaaagagccgaaactggaacaattctcacgtcttagttatgatccggacttgatttaccgtcccacccctgtacctttctatctttcacaacccatcggtatgcccggcgagatgacttatcatgagaaatcaagtactgaagcatctccactgaatcgagcactgccggggtatgacacggaagatacagtagcattgctttatgaagcagcattgcggaagacattcgaagaaatggaaacagactggcatcggaacgatcatgatttgcaaacgttagtagtcccgcttgccgaaaattgttactactccggcatcccggaagaggaggtaacccgacgaaccatcacgcgttattacaaaagaaaaaatccgatgctggtacgcgaaatgataagaaacgtatataaggaatgtaagggagtgcccaaaagcagctgcctgactaaagagcaacgtcttagcctgcaaatggatgaatttatgaaccgtcgttatgagttccgttataatacgcagatcggggaagtggaataccgggagcgtttctcgtttcagttttactttcatcccattgacaaacgggcacaaaacagcatcatgctcgacgcacaatccgaaggtattggcgtatgggatagggatatagaccgatacttacattccaaccgtgtgccgatctacaatccgttggaagagtttctgtttcatctgcctcattgggacggcaaagaccgtattcatgctttggcaaacagggttccttgcaagaatccgcattgggaattgcttttccaccgttggttcctgaatatggtttcacattggagaggggtagataaaatgcatgcgaataatacatcgcccatattagtgggggcacaaggaactcataagtcaactttctgccgtgaaatgattccacctgcacttcgcgcttactatacagacagcattgatttcagccataaacgggatgcagaactgtatctgaatcggtttgcgctcatcaacatcgatgagtttgaccagataactctgccacaacagggatttctgaaacatattcttcaaaagcctgtggtcaatctacggaaaccgcacggtcgctcggtacttgaattgcagcggtatgcttcatttatcggtacaagcaatcagaaggatttgctgactgatccttcgggaagccgccgtgtcatttgtattgaagtgacgggaaacatcgacactacacagccgatagattatgaacagctttatgcacaagccatgcacgagattcatcatggcgaacgctactggtttgacagtgaggatgagcagattatgacggaaaacaaccgtgagtttgagcagacaccggctatgctgcaattgttttatcagtattttaaagctgcgcaaacgaaagaggaaggagaatttcttactccggtcgaaatactaaattatctgaaaaagaaaagcggtatatcattgtctgataacaaagtatatcacttcgggagattgctgcaaaaatgcggtattccttcgaagcatacttataaaggtactgtttatcaggttataaaggtattataagagataaaagtaaggctgacaataaaagtcgggatattttattgtcagcctattatcaatggttattgtcaggtgacagagtgctgatattcatctacttgaatgtatccctgacagtatgacaataaaacaggtacaaatctaatatgagtagtaacatacgaatcataagagcccctctcacattccctgtttagaataaatccattgcaaagcctgtgaccaatgttccggataaacatagtgctcggcttcctccattatcacaatctctttaggggaagtaattacgttatatacagaaaatgtggaagtaggaggacataccatgtcgttatatcctaaatagaagaagaccgggactttcagctgctttgcgaaattagccacatcataataagaagatacttccaatttcttctttctgatttcgacagcatcggtggagtctctgaataaatgcggccatccacctgcccgtcctttctcatagccgctcaaatcgctaagtgccggaaagaagctaacgactcctgtcacacgcggattaagaaccgccgtgacgatggccaacgcacctccctgactacctccctgcaccaagaggttgctgccatcaaattctttcatagaacaaagataatctaccgcacgtacacatcccatatagacgcgtttataataaacttcatcacgattgtcccaattctgatattgatatcgataaagtcctccctggctcaaactagcataaacggacggttctaatgttaccggaataccatggatgccaatctccaacgtaatcatacctttttccgcttctacaatcgcaccggcatatccccgtactcccgctcccggtacccgcaataaagcaggatactttccgggctttaccggcacacaaagaataccatatacccggctgttcaaacggtagttctgtacattccattcataaacattcaccttctcggtacaacgttcgggcagtaaacgcaatttcacattcataggaattcgaacattctcctgtttggcactttcccagaaagtattgaaatcgtttggcaaaacagctgtcggttttatcttctcaggttcaaaggcagccgtagcccgtccttcaacagttctaccgtcatattttgtccagacacgacaacgcaaaaagccaggagttttcatggttccggcatccaatgtcagcacaccattttccaagacaatggtatctttgagtaatggatgcatcatatcctgagcaacttcataccatacagtcacattttcttgaggtacacgattctttgtcaccacaacgttgaatttcaccttctcacccagttcgtacttccaatcgacatgatcaggtacaacattcactttaaccattctttcctgcaattgggcggacagagccgccgccatgcagaaagaaatgaatataaaaaacagtcttttcataaactactattcaaaaccttcgctacaatacagaaaagtcccataccccaaatgagcaatatcagtaccggcgttttcaggacgaacctttgtttctaagacttctttcacataaggcattcccaatcctaaacgtgtcgcataatgattgtacacccgctcatagacaggagcaaatttaccacgtcttgattcaggtctctgaccactggctacctctttcttgtctacttcgtctatttcataccaattatacttcccggtgagttccggcatatacttgaatggcacatcataccctaaattatatttagctgtatattcatagcctttcggcaagcggttgtctaacacaccgtagagatcagtaccttgtttccaggccgtctcacaaagcatggacatcatacctaatcccaactgtgcatgtgtttggtcacgaccactttcctgacattgtccagtttctccatctatataataacgtatagaaccattttcatatccgtaaagataaatatctatagctttcttatacatttccatatcatccaatacaatcgccatggccatgtaacagttaatggcagatacgccaaagttaccgactgccttattcttaggctctgtgatagagaagaaatcatctaatacgggaataaaacaccgcttaaacatatcacatgctccctgaaagtcctcattcgtcatcccggaaccatcaagatatcgcataagctcaacagcataaactagttttatgcataagttacccaccatcaatacatgatccaaaccggcttgtctcgcactatagacaggctttttaaggctggcggaatagccacgtattatctccattgacttatcagcatagcctttttgttgtgtagcagcaaacataatggcattctgacaagctgccgcaaaatcgtttccaaattgattcatgatgttcggatgagaagcatcttcaccggcataaatttcatcataaggaccattcattatatatgtactttgagagagtttatccgcgctcaataattcataacccgcatattgtggttgtatctgttgggtagcaatcttacgaaaacgctcgatgtcttctacagtaaaaacaactcccgggtgttcaaattccgtagggtaggtcacttctatgcgaggcaacggccaactatctatatcggtcgtcccatcttctatttcactgttacacgagcatagtgaggtgcaggcaatcaccatgcctgctacctttatctgattctttatataatctatcttcataatcatttaactataaggtgaatataagtccatattatttcccagcctcaacctctgaaaacgtcatcatttcttctacactcttaaatgtacgtatccagtctgccgagaatgaaggaatatcgacttttaatatcttgaacataaaggctctaatcggaacaaccccttctgtattggtaaactgtgctaaggaagatgcgtcataataaaccagttgtgtaccatctgacaatttctcaactttcatagccggtgcgatatttacggtatttcccaagttagcaagattaagagtatattgtgcacccgatggtatatctgtgcatttcatggcaatcaccggataatctttaaaattcatatccatctgattagctaccgtactatagactctttgcatatacacgcgcttattattatcagcagtcacggtcataaccagttttccgtctttacgctccatagagccaatattactattgatagcccatccctcaaagtctgttgtggcatcccatacataaaaacctgaggctacagtcaagtcgatagtcgatttattgccagtctctatacaagtggcagtaacagtggctgctccgaagcccatggctttcacttttcctccttccacagtcaataccttctcatcgcttgatgtccattccacagaacttacagtagctacttccggtgttagtgtaaagtctaaatcaagttgctgtttccagtagagaacatccgtatgaggaacaatctcaacattcgtcgcaggttcatatttcatcactttcaatgaatattctcctcttacattactgccatcgtgcgtatatgcatagatagtcacatctccggcttttatccccgtcactactccattcttatctaccgtcgcaatattttcattgctacttgcccaagtcaaataagaataagtatggtcagcaggcaatatatcatatttcaactgtaatttatcagtttcgtaaactccttcctcaatgtttgtaaactgaatcccggtagtcttgattacttccggaatcactgttacctcgatagtccgtacagtggatgctgttccaaatcctaccgatggagttacggtaatcatcgtttttcccaacgatttagcagaaatcgttccatcttgtgatactgtagctaccaattcgttagtagtcgtccacttcaactctgtatgatccgcattttcgggagtaatatgatagacaatagttgtatctgttcccaactgcacaggcagttcactactcacttccaatgaaatagctgtaatcaacttgttctcgggcatgtcagtagtaaattccttctctccgcaggaagctattaacagacataagccaagtaatacaccagcctcccaatatcctttcttaaacaatgaatatctgtttttcatgtcacttacaattatttgtttttattattattcccatccgggattctgttgcaaattaggattcaactgcaactggtcactcggcaacgggaacagatagttcttttcttcccatttacgccccttttcaataatgatacaaccttcagcattggtctcataaggacaattcgcccacactttttcatactccgtacctttccactgaattcctacaatatccatcggcatttctgtttctgctgtcttccaacgtttcaggtcatctaagcggaagccttcattgaatagttcaatggtacgctcacggcggatttctgtccgcatatccatacccgcattttgggtaatcagttcattagtcaatggagtcatagccggattaacacggagacgcaccaaattcaaggaaatattcaggtcagtattcgagatcttgtcgtcccgttcatacactgcctctgcataattcaacaaaacttcagcataacggattataggaaaatcataaccttcttttttatcttccaccttacgctctgttgcccatttctgattgtgatatccggtccccgtcttcggcacaaaattagatatatatgggttcttatcctttccatcccaagaagtacgtggtttctgattgttccaaaagttatcgtgaggacgcatcattgtataacgcatacgattgtcacgatcctgaaattcatcatctattttcatataccctttgaattgagggtttgtttttcctccataagtgatgggaagtccattttgacaaagatacatattggcgaatttacgactaatccatattgcattatataatgaactttgtgtaatattccagttgataggtgccaatatttcatcaaagcgccgagcaaatatatattctttattagcacttttctgtaatccggcaggattagacttcgcatcctccaagatgaacatatatttctgtgcactgtcacccaatgcttccggtttgaacaaactgaatgttttgctatcgatcacgtctttggcagctttcgccgcaatatccagcagttcttttccacgttctacgttaccacgacttttttgccaggtaccttcgtacaacgccactcgtgacaagaatgcctgacatccttcccgacttatgcgcccatactcttgtatttcggagaacttcggtaacagaggaacggcttctttcaaatctttaatgatgaaatcagccacttcactacgatcattctgcttgacatacattcgcgcatcagttacctccataggttccttcaccaaaatagcattgccatatagttgcaataaatcgaaataagaataagcacgaaagaattttgcttcacccacatactgggctatgtcactcggagtggcatatgactctgcatttttcaataacaaattcgtacggcggatgtgcgagtaattgctggtatagttagcatccgcaggctgtacagcattgcttccattgctaaataaattacgttcatctttattggtaaacagatctgaagtataatcagaatgtaccggttttgtcgacttatattccattgctcctgaaaagtgacgtgtccagccatagaattgattggcaaatagcatatagtcatccggtgtgttccagtagttcgtttccgccaactgttcttgcggctcgagatcaaggcaagagtgtgtggacagtcccaaggttaaaacgacaaacagattttttattttatttaatctcatactatttaatatttaaaaggtcaagtttaatcctaccgtcaggtttctcgtaaaaggatagcggccaaatgtctctactttgcgcgacgcttccggatcccatccatccttgattttactattctcccacaaatcagctcccgatacataaatacgggcatagcttatgaatttagtcttcgaaagcacatttgccggaaacgtgtagcctaacgtaacattcttcagacgaagataagcaccatcttccactgaccaggaagaacaaatatagttatacagattgatctgtgtctgatgtgtgtaagtgggataatgggcgttcggcgtttctgccgaccatacattaccaaccgactgattcgttgaattattataccaagacatcatcggtatccgccaattgtcattctttcccttttgattattttcgccaccacgccatactgtgcgtttaccggctccttggaaaataaccgagacatcgaagcctttccacgataatccggcattaaaagagaaagacaccttcggatcgtcagttcccaaatatacatagtcagcttctgtcaatttaccatctttattgacatcttcatacatattatctcccaaacgcaagttaccaggcatagcaatattgttattgccattggcatattgattaatatatttatccaactgatcttgcgtttgtatcttaccgcaatatttcaaaccgaacacggaattcaacggatagccttcacgatttgaaactacaccggatttaatcacagcgtcacccccattatctaccaatttgttagtggtataggtgaaagtcccccccagatgataggaaatttctcctattttatccgaccagttaatcgtgccttcccaaccgtttgccttaaaactacctctattagcggtaggagctttatcccccaatgttccaggataggtgacatcaatcaacatattgttacacttcttccaaaaaagttcggcagtacctgtcagtcgattatccaggaaaccgaaatccaaaccgatattgtagttcttgatgacttcccatgtacggtctgtactcaacagcttaccgtttgtatccacataggaaagtaaaccactccccactaatgcacctccattctgtttgaaatcgtatagctgcacaccatcgtatcgatcaatacctccctgattacccactgtaccataagaaagacgtagtttcaaatcatcgaaaacacccagccctttcacaaactcttcttcactgatacgccatcctccggatacacctccaaagaaagcccaacgattctccggctgaaatttagaagaaccgtcataacggaaatttccttcaagcaagtatttggatttatagttatagttcaaacgtgcaaaataagaaagcaatgcttcctgatatctggaaggtccttcattctttgtgttgcgtaatgttatctctcctattccgttgataatattcagtgaaggtaaaatattcaaagccttagttgcagtataatcatattctttcatgctatattgcgtaccaagcatcattccgagattatgactaccgaatgtccgcttccagttcaaatagaaatttaacgtatacagattggttcgtgcagttgttttaatataataagtatcctcttgcctgggttccacacgcgtttcccgttttgtaccagtgtagtcataataatctactgtttggtttttcacgtcccgaatggcagtagaggtgttataccccaaagtggctactgcatcaaaatgctcgtcaaaacgatatttaaatgtctcactgatattgataccggaagtgttgagtttgttgtctcctcccaattcacaacgccagttgggcgtagcccagttaccccacgcataaggtttcccatccatcgtggaagaaggaaaacccggttgttgcgttccggctgtcaaagcttctccaatttgcgtcggtgacacttgatcctgacgataatagaaaatgatagactcaagatcaaagttctttgtaagatggaatgtattactcaaacgaaaattataacgttgattcttattgttaccccatttcaaattactatcatcatacatatatcgtccggaaagacggaagacagacctttcgttaccacccgatacgctcagttcatgtgaagtggaagctgctgtcccccacatgatatcttgccaatcggtatcaaaaaagacgaagtcgtataaaccttggaaagaatccgggaaaggattacccgactgctccacattaatataatgtcccttattctgacgagccaaagctacgtattgcagccattgatcgtctgccagctttttgttatcattcaaacgagcttgttccatagcatcacaccactcatccaatgtcatcagtgtaggctgcaaccctacgaatttagcagttaccgaaccactatattccacctttaccttaccttctttggcctttttagtctgtaccagaacaacacctccggcagctttactaccatagatagctgcagaagcgtctttaaggaaattgatggactctatatcacccggatttaattgggaaaaatcgtcagactccacaccatcaataatcaccaacggagctgaattattcttcgagaatgaaccgcgtaatttcatattccagctctcatctcccggagcagccgagttacgggttataatgactcccggcacttgtccttgcaaagcctgtgcaggattagagagagctcccttatcctttaacatcttgtcactaactacggtcaccgcacctgttagtgtttctttcttctgtgcgccatatcctacaactaccacttcttcgagcacttcagtactctccttcattgtcacatttagtaccgcttttacacctgcatcaattatttggtcttcgtaaccgatataactaaatttcaatttagtacccgcaggaacatctagcgaatagttgccatcaatgtcggtaatcgtaccacccgtttgtccgactacactcacattgacgccgataagcggctcacctaacacgtcaatcacttttcctttaattttcttcagggtttgtgctaccgactgctgttcaccgacagccgcttgtatcccagcaacgggatacaccacacacaccaaacaagcaaagattgttatcttcttcacctgctttaccatacatagcattttctttcggagtttcatgaaattaaatctgaggtttttacattattatttttattctcaagactcggcaagatgtgcagacatcccgtcattttactttttctgctttttttcttcataggcttcacttctatttattgattcagttcatattaaatgcaattcttcatatatcggcgcatgtcacgacgtcctaaaaataaatgataatctaccgtacgctgactaagattcaacatattggctatctcttccgtatctttttcttcataacggctcaacgcatacaccgtacgccgttgtacaggaaaggcagcaagtatccgttgttctgtcttacacaagtcatcggcaataatcttctcttctgtttcattagtaaaagaagggatcatatcatagatataattattcacttcttgttttttgtagtatctgcgtaaataatcggttacgatgttacgggcaatggtaaacaagaaatactttacagtatccggacgaagcatttgtttataatccaataaacgtacaaatacatcttgagccaaatcttctgcctcacaacgatgagtgatgcgataggttatgtaattgagaattatctggtgatactctttataagagcaagttatgatatcatcaaaagtattagccatcattgttattttaaagttctctataatattgaataaaggcagcaagaggaattcccattgtcggataattaggatatggatggggatttccggtctgtattccgtcacgattccggttgtaccctttttcattatcaatggtaatgcctatgtcaacgacatagtatccttcactttccctaccatcaaatgtatcaatgatattttttcgcagttgccacatggctgcattctgccgtaacgtaaaatctcctctgatattgttgagcgaaccacaggttgtacacgggatcagaattataaatttaccatcgggcacagctttgtaatatgactctttcatctcggcaatctttttattccattcccgataatcggccgtcaaactgtcgcgataatcattgagccccaacatctgtgcaaagaacttaggtgcatcaagattccacatatccagatattttctataattgaaagcccattttctctcatcaacctcaacattcttccacttcttttctgtataaaccatgtagcttccacgtgcattatcatacattaaatcgtttttcttcggagctgccaaataacctgtctccttatcgaatttagttatgcattgatcgtatctcccacagttatagactatttcagtatctgtcagttcaccattaatcaccttataacagtttttccaaaactcacaactcccccaatatctatattcacccacaggttgcatatatccatgatatgatgtcatctctcctttaggaatctcgaagtatttcttcactgtccatccaccccgcccttcatcatactgtccttcttcattctttatattccttagtccgaccagttttataccaggaatataattcttcgacagcaacgcgtccctgaaaaaagctccgttgacaaaactgtcccccagtatctgaacagtaacttcctgagttcctattccttttttccctacgcatatagaaattgctttttcttttattatttcaaactcatccgaattgaccaattcgattttcatattcgatccatccacaggagtatcgacagaagctacacgattcagttttctcgaataaacacagtcacccgaaaatctcacaaagtcattgtaaggtctccatcttttaattagtgcttcgacaaaaacatcattccttatatccgaaagcatatacagtttgcccggaatacaaatgtcatttttaaagttacttttctgtccccaaagcggatgaagtgaaaaaagaaatagtggtaatacaataaatgttcttttagatagaatattcttcatggttccatcattttgcagttcatagttatttttaatcacactgcaaaaatagacgaatccaatcgacaccattgagataatttgtcccgattattaggttagtttgtctcattataccctttttagggcattttcagtatataaatgggaatggagagactttttatttagtctctccactaccattcgaacgatattgcgtcggagtgaatccgaactcttctttaaagtatttattgaaatatttaatggaattgaatccgaccctgtccgaaatctccgaaatattatatgaactgccccgaagcaactgggcagctcgtttcaatcggacagaacgaataaaatcattcggtgtcaatcctgtaatggactcaaatttacggtatagctgactacgactcatccccaagtcatcacacaagttattaaccgagaactccggattttccatattctcttccaccaaccgtaaggctttctccacaaattcttcatctaaagaagtaatagtgatattctgaggagagatttctatttctttatgaaatatttccttacgcttttcctgctgttctaaaagcatattaatacgcgtcagtaatatgtcataattgaaaggtttcgatatataagaatcagcaccagctttataactttctatccgagcttcgtctgaaatacgtgccgtgagcaagataatcgggatatgtgaggtctgaatattgtttttaatccggacacacatttccagaccatccactttcggcatcatcatatcggatattatcaggtccggcgacttatgtatggcaacttcttcgccttcggctccgtctccagcctccagaatattaaattgacctatcaattgttccaccaaaaaacgacggaattctacattgtcttccactatcaaaatagttttcctgtccgaatataccaccttttcttccacatcgggagacatagccggaattttggattcactgtcgtctcctttcaagtcggatggaatatatatcaaaaatgttgttcctactcctattttgctatgcacttctatctttccgttatgcaaagagacatattctttgaccatatgcaaaccaataccggaacctgtcacaccaggaattggctccgactgataaaagcggtcaaatatcacattcaagtctttttcactgattccacatcctgtatcggatatttcgattcttacgaatatcttttcatcttttttctccgtcgctacaatcgttgagataagccctccatcaggagtgaatttaaatgcattggaataaatattattcagaatccgttgcattttcgtatcatcaaaccagatattcatgccaggacattcactctctatcgaaaactttatagatcgatttgtcgccagttctttaaaccctgaaccaatgtaccgcacaaactctacgatgtcagcctgatgtaatttcagactttcacctcccatctccagtttccgaaaatcaagcagttgattaatcaactccaacaaattaccggcatggttatagattgacttcaatttgtccttcattggattctccgcttgttgaataaggatacctaaaggcgtcattatcaaagtaagcggagtacggaattcgtgactgatattggtgaaaaagcggaacttcatctgattaagctcttctttctgctgttcacgtttcaatgcctcttgttcgaactgctttttaagttttttcttcctataagcttttaaaaacaaatagatgactccacctgcaatcaatatgtaaaatatgtaagcaggaacagttgcccaaaaaggcggagaaacgacaatagtcatttctgcggcctgttctccccaacttctgtcattattggctgtgtataccactaatttatatttccccggatgtaaaccggtataggtagccactcccagaccattggtctttatttcattccagtccggatcaaaattctcgagtttatacctatagtaggtttgcaaagtattcacatagttaagcccggcaaattcgaaagtaacaaagttctcattatacttcaaatgaatctcacgagtattatttatcggatattcaagaataacacgccctttatattctgtgtgttccttaacaggagaattgaacagacggaatgcagtgaatataggtttattgtggacatgattataataaatcttttgaggttgaaacgaattaatgccatgatgaccgccaaaatacagttctccatcacgggtttttaacgatgaattctcatagaactttcctccctgcaatccgtcttctgaactgaagttgactatgagaaaatcatatccttcagaagtctcttttaattcaattcgtgagataccacttaccgttgatacccaataaataccgctatcatcctcaatgattgacgatatagaattgttagccaatccggtctctgtagttatcgtatgagctttcttcttttgttcgtcccatacacgaattccaatatccgtcccaaaccattctagcgaatggctatctttgtacacacaattatagcttacctgaggccccataaatttaggattatccggatcgtctatttcaggaacaaagattttatctttatgagtatcatagtagtaaataccattttccccaaacaccgcaaaagtagaattgctgacaggataaaaaccataatcgcgtttatgaaagctaatcttcggatgtttatcccgcaacaatcgtatttttcccgttgaggtgtctagctcacctactccttcattactgacactgacccagtaacgcccatccggatcttcataaactgctcgggagatattctgctccgggaataactctgtattaactaattgtttattgtaatatctcacattttttccatctatgcagcaaaatccattcaaatacgttccaacccacaatctctttttactgtctctataaagagtcagacaaagatcaccggacagaatatctttgaatgccctgctgacttctcccgtagaaggagagtaacgcatcaatccgtatgcagtagtaccaatgagtatcgttccgtcttcgtcttccaacaaacaacgcaccgattcgttggtaatcattgttttattctgaacagtctgaattagcttgaacttatacatactcggattatagtaacagataccttgccacaaagtgcctacccaaattccgccattattatcggcaaagatgcactgtatgtcattacttaacacactgccgtcacctaatttcaatccgggcattgtttcaattctatgtgtagagttttcaattttccgcaatccagaccacgaagaaccgacccatgcgtttccttgcttgtccaaatccatacaggtaaagaagttggacatacctttaatggtgcttatctcttgccaacctttatcagttttatcacgatagcaaacagcctgattatacatcagccatagattcccatcggaggtagattgtatttttaaccggtctgtagcttcagagatacgtcctacaaaaaaagtatcctgaccggtgtaatctcgcaaggttttgtcccaacgacgaattagcccgctcgaatatacgatataataagtattcttatattgagctaactcgtacggaataccgtgccgatatgtaaagtcactgttccccttttcgattatctgtaattctcctgcggatatatcaaaaaaatagaatgtattatcttcggtaagaaaccaatagttcttgctctcatcaataaacaaattcttcaattttccacttactcccatccggcgtaattcggaatcaatatcataaataaactgattggtattcaaatcgaataataacaaatatcccggagatttcatccatatccgtccgtaagcatcgtgataatctttaaatatttgattccggttgaaatcccatttatagattttccgcctatcgtgataaaaatgttcgaatgtagcaccattgtagatgtttaaaatagaagctgttcgaatgaccatacgaccatccggtgccattgtaaaatatcgtatttgattatccgacatcccatcaaccacatcccaatgccgaaacatatattgtgagtataccttaaaaatgcttagcaggagaacgagtgtgataatgcttgtacgctttgtatttttcataagccagcctaatttgccagacaaaaatagagattaaacatcaatacaacaagggtatacattataattttcgaaaaaacacaaatgattaagcgagatagacgtttcattcgtatttcatttaaataaggaaccaatttatgcaaaatgtaatatgaaacgaattcttttatgtctttcagcagctttatatttactttttatccatgcagaaaaaataaagcatccagccttactttatacccctcaacgaattgagcaggcaaaaataagtgtcagacaggatacacgaatgtctgaagcttggaattcaatcaggaaaactgccgataacctattgcagaaaactcaattgaataagatagactatttagcactctcatttctaatgacggatgaaaagaagtatgctgataaaataaaagagattttgctggatgtcactgaggacgaaacttggggcaatcaagaaatgatggctcgtaccccagcctggaacgccgaccttgagattgcacataaagctttttatgcaggaatagcttatgacgccatctatcaagaactttctcaatctgaaagaagaaaaatagctcacggattaaaacgtctggcaatggacccgctattaggtgactggatcttggagccaacacgtattcattcactaaactcaatggggcacaactggtggacttcttgtacgtgtatgggtggtctacttgcactaagcttacagaatgaattggaagaagcaagagatgctgtaaagattatcaacgaagtccttcccgaatggtttgagtttgcaggagatgtgcttcatcaaaagccaaagacctttgatgagaccggtggaatgtatgaatgtctgaactatgcaaactacgggattcaagaggctttattattccgcttagcttggatgaatactcacaaggaagataaagcaatagagataccccaactggagaagttatcagatttttttgtacatatctgttatccacgtacaggtatgctttataatataaacttcggggacagtcataaaaacacggctgccgaaagtagtctgatgttattatatgcaatggggattcaaaatgatgatatgctttggtatatgaatcagatagagcaagggcaacaccgtgatggatattttatcgaccgcccgataggatttctctatactcccgatttgagtaaagcacccaaggttcctaaactaaagaaatcacaattattcaaagacttcggttgggcaaccatgcgcaactcttgggagaaagatgccacaatgttagccgtcaagtccggatatacctggaatcattctcatgccgatgccaattcattcatagtctttcataaaggagaggatattatcaaagatggaggacgatgttggtatgcgaatcccgaataccgcaactacttctttcaaagcgaggcacataatgtcgtattattcaatggcaaagggcaaagacgagaacagcaatattatggttctaccttaagaggatatctgcattatctgttggatgccggaaatataaaatatgtgttggcaaatggtacaggtccttattcggaccagtttagccgcaacttccgtcactttttgtggatagacaacgtcatctatatcattgatgatttaaaaacctatgaaaccggtcattttgaatggttgtggcatccgggaggaataactgagaaaaaaggggttcttcgtcaaatttggtggtaatctcttttttatttcaactgtcttcttctttcatgccacaaagatagtgtttttaactaattcccccaagttttcaaactgagccaatatatttcgtttatgggttaaacggaaagatttatgtattatttgttagcattttaacttacttaattgggggtcaacaatagaccaacaacaaggaatattaggtaggatttagcatgatttgctctctaagatgcctatttcctgaaagcagaaaaccctcataagtatttaacttacaagggtttttgttgggtggaagaccggactcgaaccggcgacattcagaaccacaatctttaacgagtagccttatagtggtctcaactgtcagcaagttaaatatctccttgctagctcattagtcaactattagtcaacatgatagtattgctactaatttggctagcttctccaccattttatatggtgtcagtgtaacaggtttacctgctaatcactgttaaactctaaggtgctttcttcattacttttgattttaatgattgatgcaaatatagtgaatatgtttggttctccaaacaatctctaactttatgttgtagttgaactcttcttgcattactactatgctagtatcatactactaatagcactttgaagtgctaagtttcttgcttttgtttcataactaaatctgctgaaagtgttatttatgatgattagccatccatttatccatattcatatctttagatgatataatattagccttacgttgtaaggttgctcctaaagaaatctctccattaaattcccgtattaattcattctcaatccattcattgtataaatcaagtgctgctatatattctttaccatatctcttttgtatttcagtaactatatcttcttttacaagatatctatatggtctataatgtgatactgtaacaaccttaaatgttcttgagaatatatcaaatacatcactctcatatttatatgaataggtacgcttaattacatattccttatgtctttcttcatttaaatcatctaactccttctgatattgtcttcttctagtttcagcttctaatctctctttggggtcagataagacctgtctaatttgcttatgtacttcatcaactgatgatgcattcttttctatattttcacatttgtcactgtatttagccaaatcatagttatctttttcctcttccttctttctgtctatactatttaaatataaaaaaaagagaatagcaaggattgttataagtccaattgctgctaatatattatacatagttattattcattataaatacaacattctttgaaatcaatgatacatttgttctccaaaagaaagtcagtcccaagtaagccgtgtacctgtatgccactttcttcttcaatgccactaaaggcatccagcaaaggtcttacacagaatttgggcttatatatctgaccttcaaatgtgaaaggcagagtaatcatatctaccttgtgcttagtcccttcaattccactgatgcaatagtcaccaactggctctactatatctttgaaatattctactacagtactgtctatcaggctacaggtgcttccagtatctaagatgaagcaaaggtgcttgtctttgaccctagcaagtataataggaagaccaacttttgtgagtccataagataaatctcttcttcttggtgtgctaatatgttccatctctctcaagtgttaattttagctgtttctgccagcccaccaaaatattactatcaagatgattgcaacaaatagatagtcagcccctctgtctggatggtcaaatagaatctccatcatactttaattctgacttaaggctattatttacccctgatagattgcattatactcataaccagtgctccaagtattaatgaaatccatagttcagcactgcaccagatgcttttccttttcaagttgagcttcttcttgacctcaaggggaagtttctctatttcagtctcatttagcttttccaacacttcatcagctacagcctttagtgcctgttctgtcattccattgagctgttcaatggttaatgtttgtagttcttttttgttcatattacttgattttaagtgagttaatcattgtatttgcaattaccttttgtttactgtgccttgctgcatctgttgttgcagtaatgataaaggttgtgttatccttcttctttactatgtattgtatgccatgcaacttgtacccttgaatgttaaaggtgtagtctatcacacttccttgacagttgtttatgtagatgtcatcattctgttctagtaggtgataactgtccattatttgcttattttgggctattgtgttctgggctaaataagaggtaggttcactccatttctttttggaaacaatgatgttaatattaggtctaaagtcatggtcattcttcaatttctccataatctgaacagagacagttgtattaccagttacttggttgtcatcctgaactatctgccatgtggtagggtactttatagagaagtactcattagagtattgtttgtttagagaaggatcagttgtagctttgatactctgattgttggtatcactgctgcttgaaatcatataatgtattccatctgtgcctaactttctcaacatgatatcatagtcatgaaagttgtactccttagtactggatatgtccccaatgacagtaagaggattgcaggacattagccaagcatccattgacttcaatgtttcactagtcttatcatgtaatatgatattggaagactgaattttgatatatccttttaatacatatacttccatcatcatgttagtagcttctgccctgtacaacttcattccagatttcaaagtcttgatatatgagtaataactcctatcagcaaattcactccatttggtatttaaactatgctgaataactcccttcttgaaacctttagcttctgcttttcggacaaaatattcttggactaatgagtcgacagcttctgctgttgtctctgttggattttgatttttcttggttgtgccttctagctttgatagataacctactatgcacaatgtaaatatagttccactaaggactgtgataaatatccccaaattttctttcttcatatatattccttttgtagccatactacaaaaagaagatgtgagcctaaccttattgggagtccaaggtattaccacatacctacaatcacacaatataagggaagcccacacctaatggtatgagtatccactacttactgctgtgattgttagtcttcaaggtggtaattttaggactgtcacaagtaagaagcaaacacttctttatctaatatgtcttagttaaacttctatttcattagttgtcatttaattaatactgttgcaaagatagaactttccagtaatacttcatcacttgactgctataatttaataggtttaaagccatatcagtaccataggtgtaggcttatattcttattgcacaaaggtagacttaattattcactttctgtatgcccaattgataaatagagcaccagtagctatcaatatgaaccactgtaatatcatatctaatgctgtcatatatacattagttaaagccccagtccatgaagaactagggctatcaacaacaataaaaacacatagtaagaggtatataacctcttaatccttaagtatcatactggtgaggataaaccccactagaatcaagataatctcacacataattcaatcaatatttaatttagtctaacttactaactattgctataattcatgtttacatacttcaccgaacctcaagtggttaagttattatagcagtacatctctttaccctgtaatcaaataccctcaacctatattaaaagaggcagtcaacctctataaaactatcccctgatttgccattctgcatcacttactttgtatatataatatgcaagaaagtgagacaggagaaatttcccatcataatggtataataacagcagagggggatggatttaatagaaggtaggatattgtagaccttagaaggttaaatgtttatagctttccttcatcatgataggagtaatattccttctctggacttaagattatatggtctgctacatgaatttccatgagttcagccaccttccttactttttcagtcaaaacatcatccagagtactgggtttcatgcttccagaagggtgattatgtgccaatattacctgtgttgcattagccagtaaggcagcttgtaatatcaaccttacatctacataagttgcagagattccaccttctgaaataggtactatacccagtactctgttagactgattaagcagcaccactttaaaactttccttgtattctatagtgtcatcagggaagcactttatcaatagttcataggcatcctgggagctatttatcttgtatctagttgatgatttgacattgcttttatagctcaattgaacttctgatacattcattatattatccataagatgcactaattaatgaaccaactatattcattttcaccatataaagccttattaagtccttcagccaattgagtggcattaagtgacctgtccaagaagttgtcaatgtaactgctcttgttagctccagttagtaagttgtatacattccacatgctgatttccctgctgtccaaaagggtgctaaagttatcatcattgtaatatgctttggcaactaatcctatctgggtatcagtcattaacatctgtggtaacttcttcttctggtctatgggaaggaactgatataatctgcatctgcctaagaactgggcaaattgggattctcttatatagctatccttataagctgacatataatacaagtgttgggctatattgtactcttggaacagcctcatcactgcattgaatagttcagttgtactcatgacctttaattctgatctgtaaccatctgttgatacacacatgttacagcagactaaatttttgaagccaatgaataccttgaatttctctgcacccttcttgctgtacagattcatgtgattataagctcttactccacctatggttaaattcagtctgttacctgcaatatcctcatatatggtaggtatctcaaaacagaacatcattctctcaaagtagatggttttatcagattccaatagttgattcactggtttatgaatagcttccggtattctacctttgataacatggcttaccctgatggcaggttcttctattctctcattggagaacactttgttagctgcttcccatgcagtttcaatgaaactggagtgtgatatagtaacctcattgtccttagaaaacacaggtgtaatacattcctccttgaggtactgcatagtaacttcctttgtattagcttcaataaaaggtaacttattgccttctctggtgcttattggttcagttcccacaggatttgttgatataatacctgtgttgatgacttctattggctcaactgtttgaatataagggttattcgccttatttctattagggtatatcagattagctctgactggctgcaactgcattatttccatatctaatgtaattaggggtatagttaatagttggttgattcttttgtacctgaagtgctgctttcttctgcatgaagtctgatgttaactgttgataccattctggataagcatgatagatggcagtcagttcttcaatggtcttgctgctgttaatcttgctccttatcatctccagattgacaccatcattacaccaatctgctatgatctgtcctgtagtaggtgtaatggtaaaatcaggcttacctataaacaggtttgtcctgtctttagatgcaatagtctggtgcttcatgttgatgtcaaagactatggtaaactcataatctataccatctctcatgactgctttaagtcctactttctctggtatcatcttgccattcttctcacttaaaacatagtcttgtttgcatctcatagtgcatataatatggcttccagactgcaatattttctgcatgaaagcattgattctgggtgtcaccttctgccagttagtgaagctgttaccttgtaatcctgcatggtattcaagcaagttatcccaacactgtgagatgctatcaattataataacttccatgcctgcaccttcacatatttcaatagcttgtatataagtttcaggtgtaaagttatcacttaaacttaatacattataagcacctaagtgagcataaaggtcagcacttccattctcactatcaatgatggctatcttagtccagtcattgcataaaccataagctaaaagcaatgctgaataggtcttacctgaacctgcacagccttgtagagcaagcttaattttagcctgcttcttggatgaaactcttaaattcaacatatctgaataggattaattgttatacacagtctataaagaaaaaaggaagcaagtcctaataaacttgcctccttgaggtctatattgacacccatcatagagttgccaatgtcatagctccaccttcacctctttgatgtagcatatagaacatatcacctgtatcaggtgagcatacttgggagacaacaggattggtaacctctccattgatgaacttgtcactgactgcaccagtttcacagccatagacaaagaagcacttacctgtgtgtggattctgcttaacctcaatcttgcttactcccttttgagccttgaactcattcactgtcaatgtttctaagaactttaacttttccataattgtatttttattattgttgcagagggggatatcccactcctaaggtaaggggagggagactttgtgacttagagtgcacttgtaggtgtcaagtttacagaaattgaaaataaaaaataaaaattatctgaattacagtatggtaggagcagtagggagtgctatatattagttatgtacatatacaataatcccctgccttctggtgggaaaacagggggtattggggtatgtatcattcattcatcattaatagtatcaaggtaatgcttgatttcatcatcatctggtacatctgatgtaactttgtctatccaagtattgtaacccaagtgagggtacagaaggactttagcttccatgtgttcagtccatactagtttcattggaacatcataagaagaccagattactttcttctcaatcaataagtctctatactttttatatgtgttctttgctatatctaaatgactataaatgagtttatctgataggtctatcctgaactcattgttaacacaaaggcaatataaccctatcataactcctttctcttctggatttaaagagctgtcactgaataactctgcccatataatcctgaaattcttagtaggattgggtagataataaatattccttctaatctctctttgctgctgtatagtctctactctatatcctttatcttctagctcttttagtttggggataaaggaatccttgatataatctgtgtttactcctgtaagctctgacaactggctgaaagtagtatctgttgtcatgtagttacttcctctttggtagtgggcattgatatacagacctgctaacaggtagagctgctttggattgaagtacctgcaagcttcaatggggatgatagtgtatggttttgctgttgtcattaattcttgttttagaggggtcaaaatccactccatactaattacctacagtaataaaggactaaaggtaattagtatagggtgatatttgaccctaaggttggttctgttgatagttaatgtcatattagagatgaatcacttctataatcatctgattatcagttgtaaatatagcaaataatgtctgtaataccaacatccttatcatttatttggctatttattaactttctataacataaatagctttaacaaattattctccttggtagctatcctgccagtaggttctttaaaacctctaggattctcttttctgatgatatacttattcctagatgttctgtcaacagcatacatgttcttcaataaggctacatactttcttggtttcagtaccttatgtaaatgatattggactataggagttaatatctcttgtatctcacttgctgaatagctcttgtttaaggtgaaacttcttcttatagcaaccttgaaaggatgctcttcatctagtgcccaatacatgactgtattattgaagtttttgaaggctaaattgttacttgtcctaatctcccatagctgatgtagtagactatcaaggtcaacatacctatatagcttgatgaatctctctaagaatatcttagttttacttctgcaatgtctagtatatgagtacaaggtattatcattcaactgtcctgtggttgacaatagtttgatattatttatggcttcttgaatgtagctttctgtcaacttattctgtgcatccttattagccttttctatgctactttgctctggtgatacatcatagttcagggatttgtagctaatgattttaacctgtttccttagtacttctttcagtgtttcaggcatgaagtatgaggcatataactcggttctttcaatgatgtagtctatgttgaggtaggcaggtacatcctttccatatacatcctttctagtcaagttaattaactcattccctgcaattctctcctgtgctttctctcttatggcttctttgattattgcaaatagatcagtcaaggtataatcaccctgtgagatagtatctgctgattcaagtactttgagtaccttttgggctttgtttaatagagtaatagtgtacttttccatactttccattactgatacatatcctaaggtattatatatgatagtttcacttagtactccattatcctttctgcatctaccatgtatttgtgtcattctatctaaggtcaacattgagtggcttcttcttacatctgatacagtgattagatggtaactatcctctatatctataccagtgaagtagcaacaggtggcaaagttaatcctagcaggtaaggtatcattgtctcctaatttgggtacaaagtattctcctgcttcctttatggatgcctcactacataggatagcacattcctttctggtttcttcatctagtgatgctataatattccttatttggagtatggagttataggcaatgaatatcttctctgtagggtgagagataaccttttctatgacggcctgtgtgatattatctgtatgtagtaagtctatatttctatgggtattgtattgccatgttataggaaatctacattcagtctttaagtgtggattgctgaactccttcatagtagctgttaccatacatctattctttgggggaaatattaagtagtagtcaataacattctccaattggggtctgaagttattgtcagtctggagaacatcaacctcatcaatcataaggaagtagtctctatagtttttccctatgatacctaatagtctacctagactgtctgcaactactagaagttttttgtagccatctttagccaagtattcctcaatctgctgattggtaaccttctcattttgtcctttaatctcactacctacatatagagtattaggatgcttggagtgtttaccataagccagagccttagtaggaaagactatgattgagtttctctttgagtttatctcaagggtggtagctccaatacctggtatcttcttgtctacaataccatgaggcatcttatctatgaagtcagccagattccagaaggagtcaccaacttcttctcttattacttctggtactctgccaaatagtaggtcatccaaactagttattactgtgtcttgaggtatggttttagtttctcctactttcccagaggataatatctcaatgtactctacaggtgcatcatgtaagtcaccataggtattaggtactacttctactagctcttttgccagttcatcttctttgctcatatctcacttagtttgtagttagtatatagattgtaagtgaacaaatatactaaagagcctccataattcaatcaattacggaggttcttttgtgttaaacttatttcacttctggacaagataactcactatggttactaaatacatattcaatcacctttctgttagcttcattctctatcttaaagtccctttcaatgtagatgtcagtgaccttcatagcctcatcaatatgattcaatgcagcatgaacagtgtacttatcaatacctaccttgttaacagctaatgtagcccatgagtgccttgcagcatagtactccaaatcatcaattttgagtatcttgccaatctgctttagcccaagattgatggctctgttgaagttcttgaaagtagaatagagatgatagaagcagaacaccttcttctgggtgtaatcttcatatttcttcattagaggtaacaggataggaagaacatctactttcatcttagccttgtcaagtctcctgtctgtagtcttagtcctgtaataagtaattgaaccaccttccatttcagtacagttgtacaagtcagcagagtttatccctattaggcagaaggagagaatgaaacaatccttggctaagttaaaaggacacaacctttccctaccattggtattgatgatataaggcagttcccatatcttcttgattaactctactgataatgctctcttcctagttgcttcttgctttggtatctccaaattctcaaaaggtgaattaggtattctaatgacattcctgtcatagtcattatacttcttcttggcttcattgaatagatgcctgatgcttcccatgtataaagacaccattctgttggaaggtattctcttgcctttcttctgaagttctgctacttgtttagcccttttcttgtgaaggtattccatgaactccatcattaacaacttggtaacttggttggtattcagtttatcctttcctaagaaggcaatgaaggtattaagggtagtttgataattcctcttacctttgacctctgtagttgttaaccagtctttgcagaactggataaagtcaataggagtattcttttccttctctttctggatataatcaagtacatcatttaaggttaaattggaagcctctaatggaagccccatgcataactcttcatagtatctgaccaatttgtcagcttccttgatgtactttggattctttaacttgaagtccttagtcaggtcttctgttcttacaaagatatgagtagccaacctcttaacctctctgttataggttactctaatcttcacattgaaagttccaccaactttcatctcattctttctgatttctgccttgaatgtcagcatgttaggtattgtatttttccaccaacaattagccaacaattggactttaacaggttattttataccagatttagcacctgaatgataccccgctaccaaagaaaaagtcctcataagtttctaacttacaaggacttatctctgggtggaagaccggactcgaaccggcgacattcagaaccacaatctgacgctctaaccaactgaactacatccaccatgtttgcgtttctctaacgcggtgcaaagatagatattatcttctaatttccaaaagattctgctattttttttcgaaaaaagtatattcttttattccccgattgtgcttgctgaaaagggttcgcgcatcatttacaaagattttcagagagttacgtgcttgtaaaggaattgaatcaatcggcaaattgactgggagcaattgatgatttttttttcctgattgaatgggacgggctgtccataccaaactataatcacaattattgaggcggacagtgctgtcttttactaattccattcttaccatcagtcctccgttagtgcggcgggcggacatattggaaatataatttcccagcgaatagactacgagatgtttgtcattcgtcaggctgtctgtgcgaacttcgatgggctgaactacgtgaggatgggagccgatgatatggtttactcctttttcaatcagccagtcggcgaggaatttttgctctttgtccgggagtgactggtattcgattccccaatgcatacaagctatgatggcatccggcttcattgctttactctcttcaatatctttgacgatgatggctgtatcgatatagttcacgatattaggaggggtaacggggatgccgtttgttccatacgtgtagttgagcagggcgatgcggaatccgttcttttctaataaaagaggatatttcttttcgcgttcatcagcgttgatatacgtgcctgcgtgtggaacctttaaagagtctattaattgaatggttctctccagtccggatttaccacgatcgagactgtggttgttggcagtcactaaaacattgaaacctgcatcgtgaattgcggtcagaaattcgtccggcgcgctgaaagcaggataacctttgtaaggtttgcctcctaatgtcacttccaggttggcgatggagaggtcggctttctttatttcttctttgacatacgcaaagcatgtggagtaatcatagccggttgatgttcgtgcagcgttgatttgtccctgatgttgcatgaggtcacctacgaaaaggaggcgtagggtgtcggtggggaagatgctgtcggaaaggctgtccgacagggtgtcaatgatagaatctctctttgcctgcgaccgggaggtgcaggacaaagagagaagcaaaatcatcagaaacagggtatgtctcattgataaatagctttcttaccagctaagagtgtatttttcattaacgatacaatcgtcattggtccaacaccgcccggtacgggagtgatgaatgagcatttcggtgcaacttcgtcaaacttcacgtcgccggtcagtttaaaacctgatttcttggttgcatccggcacacgggtagtacctacgtcaataactaccgcgccttctttcaccatttcggcttttacaaagttcggttgtcccaaagcagcgataataatatcagcttcctgacattcttttaccaggtctctgctacggctgtggcatacggttactgtggcatcgcccggataggctttctgcatcatcagggcagccatcggtttgccgacaatattgctgcgtccgagtacgacgcacttttttccggaagtttctatgttataacgtttcaacaattcgaggatgccgttgggagtagcggatacataacacggaagcccgatggacatacggcctacgttgatcggatggaaaccgtctacgtctttacggtaatcaattgtttcgattactttctgttcggagatatgcttgggtaagggaagttgtacgataaagccgtccacgtcgttgtcttcgtttagttcacgtactttggcaagcagttcttcttcggtcacgtcactttcataacggatgagggaagacttgaatccacatacttcacaggcttttactttggcagctacataagtctcgctaccaccatcgtgtcctacaagaatagcggccaggtgcgggcgtttttcgccatgagccaccatttcggctacttcggctgcaatctcttgttttacttgttcggaaattgcttttccgtctatcagagtcatattttcagagtatttattggtgatggacaaaagtaaaataaataactgaactctccaaagggattggaatttttgtcaagagatgggggtataaaaaagagggagccgaaactccctctttttacttatcattagatttggatctacagaatgattactttttcatcttaggcatcatcttacccattttgctgctagtcaccattttcatcattttgcgtgtctggtcgaactgtttcaataggcgattcacttcttggatagtcgttccgctacctttggcgatacgcgtacggcgtgaaccgttcagtatttccggattggaacgttctgccggagtcatggaataaatgatggcttcgatgctcttgaaagcattgtcgtcaatatcaatatctttgattgcttttcctactcccggaatcatggaagcgaggtctttcagattacccattttcttgatttgtgcaatctggctaaggaagtcgttgaagtcgaattggtttttggcaattttcttctgtaagcgtttggcttcttcttcatcgtattgttcctgtgcgcgttctaccaatgaaacgatgtcacccataccgagaatacggtcggccatacgggcagggtggaactgatcgattgcttccagcttttcacctgtacctacgaatttaatcggtttgttcactaccgaacggatagaaagagccgcaccaccgcgggtatcaccatcgagtttggtcagtaccacaccgttgaagtccagacgttcattgaattctttagctgtgtttacagcgtcctgaccggtcatggagtctaccacgaacagaatttcgtccgggttgattgcttttttgatagcggcgatctcgttcatcatctgctcgtctactgccagacgtccggctgtatcgacgataacgaggtcgtatcctttggctttggcttcctgaatggcgtgttgtgcgatttctaccggattcttgctgtccagttcgcagtacatcggtacttcaatctgttctgccaatacacgtaactgttcgatagctgccggacggtaaacgtcacaagccaccaataatggcttacggttcttcttggttttcagcattcgtgccagtttaccggagaaggtggtcttacccgaaccctgcaaacctgacatcaggataactgccggacgggcgtcgatgttgatctcggctgtctctccacccatcaattgtgtaagttcatcatgcacgattttcaccatcaattggcttggcttcacagccgtaagaacgttctggccaagcgctttttctttcactgtatccgtgaaattctttgccaccttgtagtttacgtcggcgtcgagaagtgctttacgtacgtctttcagcgtctccgccacgttgatttcggtgattttgccttcacctttcagaatcttgaatgaccgttctagtctttcacttaaattatcgaacatagttatttaattacgaattactaattacaatttacttggccgaaagagggacttttccgtctactctttatttgagcttgcaaatgtacaaaaatctcttgtatttatatctttttattctgccattttgcttttttgagataaatataacttgttatcaacagcaagctataatacacaatctcaatcgtaaagcaaatttcgatcggtgctttcagccacattccgatgaaaatgatgtatgatccgtagatgataattgtaatcgtttcgagcaacagggctgcctgtgtatttcctgttccggagataccgttaaacaccacgttggctacggatgcgataagcatggcgcaacaaattacatataccgaggggacggattccgtaatgagcgcagcttcactagtgtaaatggagagcaggaattgcggaaacagtgccgataccgctactaaccccagcatgatgaaaaaggagaaacgcgcaattttattaatgagcggcatcacgtgctggatgcctcctgcaccaatagcattgctgacaagactgttggtagtcgtagccagtgcgttgaccggaatcagcaatacgacataaatactccggacgatattggcaatcgccagttcccgttgtcccaaccgttctacggctacgaagaaaacgaaccaggtagccatcgacaggaaatattgcagcatggtgaagcaggagatactaagaatccgcatcagcaatgctgggtcgaatgtgcgcaggcggttcataccgtatttctttaaatcgaccgtggcatacgtatagatgacgaaaaagagaatggaggaggcttctgccaatacggaagcaatagcagcccctttgatacccatttccggcaaaccgaactttccgaaaattaatgcatagtccagtacgacattagttaatgccatgacaatagcattgatggttagcactttagtgcgtgtaatgccgatgtacaatgcccggaacatgacattgataaaagagaaaaagaatccgtaaatacgccagttcagaaactccattgttccttcgtagatggattctgaagaaactagcaaacgcatgatgtttccaccgaatgctttggtgaatccgaatagcagcagggccatgacgaacaggaacatgattccttgaatcatgacgggaccgacatccgaatagcgtccttcgccattgcgtcgtgcgatgactatctgcgaaccggtactgaatccgaatgcgatggtgaatacgcatatatagaataacccgcccatagctgatgctccaagggctacttcactcacgtgtccgaggaatgctgtgtcggtgacattgatgacattttgtgccagcaagcttagtagtatcggataactgacactccaaatctgtttgttggtgtacataattaagtgtttaagtttacactttgcaaagatagtgctttatttcgattcggaaacgatggggtagatgaaaacaatttccggacctccgggagttttatcgttgacgagatagtttcctccgaaatgttttagtaacaacaggttgatatcatgccggatgatggtttcctgtgatacgaatgcatggtctgccaaaggtgaattagtgatccggaaacaaagcatgtcttcattctggcttaatgtgaaccggatgattcgtgcttgccggtgttcttgtgggtacaccagtacgctaatcaaggcctgtgtcagtcgcattatatcggtatgaatttgggcgtccgtttcgctggaaaattcaatctggatacctgtttcttcgttcctcatctgcgccatgctgcatgcttccttgcatagggtagtggcatcatagtcttgcaactggaacttcatcatctgagcttccaaacgggataagtcgagaacgtcattgacaagtctcattaacttctccgaacttttgtggatgatgtttgagtattcttgccttatttccttgtctatattgggttcgctggctatgagttgtgagaaaccgaccacattgttgagtggggtacggatgttatagctcatgttggacaggaagcgattttttatttcattggtcttccgcacgttttctgttgttttccggatttcgttttccgcgtatttgagtgccttccgtaccataaagagtcgtgccataaagataaaaagcagaatcaggataacaaatataaagatcagataggtgagctggatccggttgttttcccttttttgatccagttctgttttttcgatattgtatttgctttgtatctgtgccatctgattgtttgagagtacagtggctgtcgagtctttgatggcaagtgcctgctcatacagggggatggcttttccgctttgccctgcctgtttccatattctggccttttcgagtagctgttcggcatagtcgcttgtgaagtctttcttcaacatcgtcagtgtcgtgtcgatataatccgatgcctgttggtaggctccaattgcctggtaatatttggcaaatgtgtcgaaatagagtactttatacatgaaataagtattctcgtccagatattctttagattttacgagatgttcataggcttgttgcggctgatgggtattcaggtaataatagctgtagaacagttcattgaacaggtatacatcggcaaatcccgcttttaaggatgggtttgcactgatgtggttatgaagagtgttttccagttcctgcaaatatttgagtagttttttattatccttcttttctttgacaacggatactaactgtgacaataccgagatacggaccaccggattttctgtcggagtgagtagctggtaggcagcctccagtacttctattcctttatcccagcgctggctgccgatatatgcattactcaagcattgataggcagccatactaccccggttactattcatttgggaggcttgctgttgcatcttttgagattcgttgatagcaagttcgtattgttcgttgaatgtgtacaggtctatctggaaacgtttggcatcaaagaagtaattccataaatctgatttccgggcatgaggctccattatggtgagccatttggctacactgtcttgattattacgattgtaatagtataaaatatggtagtaagcagccagaccggcatatttgtcatttcccagttgcaatgcttctttcattaatgcatccgaatattggatacattgctggttgttttgttctattctgatgatttgattgagaacattcagccgtgtcgtatcgtacggtaatgtttccaacacctttatcaggctgtcggattccaaaacaatcttggtgctggcttttccggtgagggtgcagcataatagaaggatcaggagcaggacttgtttcattcggcttcctcctttccttgttgctcatggtaaatggggtgtgtgaacaggaaacgggctccttcctcataattggagtcaatccatattttgccgcccagctgctcgataatgagttggcagatagacagaccgagtcctgtcccttgagcattttcattcagtttctcaaaacggttgaatattttattctgattctccggagagataccgcaaccggtgtcggtcacggaaaacagtgctatgtcttctgtctgtttttccagttccatggtgatggaaccttgcggagtaaatttggttgcattgatgagaaggttgattaataattgttgtaaccttgcattgtctgtcgtcaattctaatgaatggagagaggtcgaaaaacggacgttagcattcgtttgttttattttctcaaccatgtcgataacgtttctgcatattgccactgcatcacatcgctcatatttgaatttcatcttgcctacttcgagactggacaagtcgattacgtcgttaatcagcttgagtaacagttctgaattttgctgaataatatcgctacactgtttccgggtctcgttgtcgatggattcttccgtcaggatggaggagaagccggacaacgcattgagcggcgtgcgaatttcatggctcatgttggaaaggaaaaggctctttgtccggatggaattttcttcttgctttttcactttttccagttcctgctgtgattggcgcagttttttatttcctcgtctgaccaaaaggatgaaaaatacaatcagtatgactatggataggatggtgaaccagctccagtagaggattgtcttctgtctgtttaagttgtccagttcatttttatctatttggtagagggtgtgcaattcattgatttggcgaatataattcattgcgtccaaagagtctttgtacgtattgaatatttcataagcttcacatgcttccttgctgtttcccattagtgtaagtatgtgtgcacgatctttcagtacttgcagggatctgtatgagttggctgctttggtatgcgaaagtaattcgtcaagtgtggttagtgcctgcgtgtattctttggattcagtgtagtagcgtgaatacaggtatttaatcattaaatgaaaatatgggtactggtgttgccggctgatttgttcggtttgtcgtatatagtttaatgcttccggaagatgatgcatctggatgcgatagaatgcctgacaataaacaaggtggaaatcgtcttggggattcgtatccttgttgataacagattcgagttcccggatattgtcttctatatctgtcatttggtgatagttgagcttcgtcaggataaattgggacaagatcgttttgatatattggttggcatgagggagtttctgaatgatttctaatgcttccttatacgatttgatggcaacttgtggtgttgacgaacttaaataggtatttccaatggcgtgtaatgcgagtgctgttcccaaaggatagtccatttctctggctttctggtacatctgattggcctggttgatggcgagactgatgttgccttctgtgattaaagcttgaacggtcagcagatttatctggaataggagtgggtattgttgttccttttgtaattccggttctaaaagtttttcccaggcaatgatgctgtcgacaggggcgtccggactaaatggatgattgtattcaagtaaaggttgtaataaagaaagacgatctgaatttgtacgtgcagcatataaggtgaccgatattaatgcggttacgactattgcaattatatgacgtctgtgttttttcacctgatataagaattgcttgcttgtaagtttatctgcaaaagaactaaaaagagtgaagattacaaagaaatcttcactcttttttataatttattttcttttgagtatctctcgtaccccagggccctcgtggttggggtagccgggagtatggtttctgcatcgtggatcggcatctactttcaaactccggtaatcgtctttggtgcgggcgatgtaatcatcaagcatggcacggtgttcggcgaggactttactgtatttagggtctttggcgagattcttgcgttctcccggatcctttttcatatcatatagctcttctccgttaccttccagatagtgagtgtacttgtatctcggtccgcgtaccatacgtccgggagtaacgacatattcatattcgctatgccattcggaaacgacataagggtgagtttttttctgtttctctccttttaatataggtgcaaggctgattcccggtttttcggccggaacaggaattcctgccaaatcacaaagggtaggcagaagatccagtgtaggctgtgtcaatacttggtctatgggctttttctgttgtttgatgccgggacctgcaaagataaacggtacgttggtcatttcatcgtagaagctgatgtgtttggtcaccatgcggtgtgaagccatcccatcaccatggtcagccatgataataacgattgtgttttttccggcaggagtggagtaaagtgctttcaatacgctgtctacttgcttggaaaccatcttggtatagtgttggaaagcagcaatgtaatgacggtaattctcttcattccaatgagaggcctgggtcatgcggcgatgactgcagcagatgtattgtacaggtttagggatattgctccagtcttctacattgaaattggctggtagttccggaagggttccgctaatggggcggtcggtatgtactccttcgttcgctcctacaaatccacagatattgtgagggttctgaaaatctgcgatacagatgaatggttcttccggcggattacttagataagcaacagcgtcttcgcatgttcctacatccaggaagctgtcgttattgaccgggaattccggatcagtgaatggcttggctactggttctttatgcttgaatcctctaagtgaacccatgtcatgcgtttttccgaagtgtacggcttcgtaaccgttttcagaaaaaagacttcctaatgtcggtacattttcgggaatacgtgggttgataggttcgctggagttggaacgtacattggtttgatgaggcatcatgccactccataaagcagcgcgtgagggttggctgagagggcagcctacataagcattggagaagataactcctcgtgaagcgacttcgtcaatagggagggtgcagccttgtgtttgtccgtaagctcccacaacgcgttgtgtcagatggtcgcactggataatcaggaaattgggcttttcttgggcctgcgctgtcacgctgcacagggctaatcccatgaatggataaatagttttcattactggttagaattaagtaatatttgatttggaagcaaaagtaggaaaaaaggaaacgtaaaaaagggcgaggtagtagttttggacgcaaatgaaagtattttgtacaaaaatgaaaggtgtggcaagcggttaggggtaactatcggtgatgggagttgaatgataagtgataaacggcaggtgataagtcataaaatgggttaccgaaaaagaaaacggtgaataaactgcacttgttatggcgcagtttgttcaccgttcatttataagtttgctgttgattagctgttcatgctcatcaggaattcgtcgttgtctctggttttttccagacggtctttaacaaagtccattgcttcgatcggattcatgtcggcaagatatttgcgtaatatccacatgcggtcaagggttgttttatcaagcaacaggtcgtcgcgacgagtgctggatgcggtaatgttgactgccgggaagatgcgtttgttggacaggttgcggtcgagctgcaactccatgttacctgtacccttgaattcttcgaagataacttcgtccattttagaaccggtatcgatcaatgcggtagcaataatagtcagtgaaccaccgttttcaatattacgggcagcaccgaagaagcgtttaggtttatgaagtgcatttgcatccacaccaccggaaagaactttaccggatgcaggagatactgtattgtatgcacgagccagacgagtaatagaatcaaggaagataactacgtcgtgaccacattctaccagacgttttgccttttccaatacgatacctgcaatttttacgtggcgttctgccggttcgtcgaaagtagaagcaattacttctgcattaacgctgcgcgccatgtctgttacttcttccgggcgttcgtcaatcagcagcataatcatgtaaacttccgggtggttggctgcgatagcgtttgcgatatctttcattaagatggtcttacctgtctttggctgggcaacgatcaatgcacgctggcctttaccgataggagcgaaaagatcgacgacacgggcagacatagagtctgaataaccgcctttgcaaagtttaaacttttcatccgggaagagaggtgtcagatgttcgaaaggaacacggtcgcgaacgaaagctgcatcacgtccgttgatcttcgaaacctttaccaatgggaaatatttttctccttctttgggtggacggataactccttctactacatcaccggttttcagaccaaatagtttgatttgagattgtgatacgtaaatatcatccggagaagaaaggtagttatagtcggaagaacggaggaatccgtatccatcctgcataatttccagaacacctactccgttgagaatatcgtcgaattcataaggcttttcgcgttcaataaccttacgttcctgctgctgttgtaccggaagattttcacccgcattgttctgctgagcggcacgtggcatcggtgagcgttgttggttttggttctggttctgattctgattttgatttgggttctgaacctgattctggttattgttgttacgctggaaattattattggcgttattgccattatttccattgttgttagcattgttattaccgttgttattgtcgcgtgggcgaacaatacgcggacgttgctgctgggactgctgctgttgagattgttgttgctgttgaggatgagatggctgttccggtgctgtctgtgctgattctgttttagtagcttcgaattttccgaataattcggtaggaagctctattttttcagaaggcagatcttcgattggaataaaatcatcgtcgtcaacgctggataagatattgctttcctcgtcgataacgggtgcagctttcttttgtggtttatctattacctttttctctacaacaggtttgttaggttcagtagccggtttatttgtttctgcaacaggcttatttgcttctgcagctggtttgttttttgctttcttctcagctgtttgctgttgtaccggagctggcttttccgtagcaccagtagctttctctgcaacaacaggtttaggttccactactttgggtgctgccggttttgcattttctacttcttttttctcttctgcatcagagctcttacgaggacggcctactttacgcttgggagtagcagtgttttccgctttagcttctacaacaacagtttctttttctttgtttgtactttcttctttcttggaaggttgtggtgcagcttttacaggagcggtctcttttgtcttgttaacctcttcactctttgttgcggaaaccactttgtcttcttttttggtaggagctacccgtgaacgctttttcttttgttcttcatttttgcgttcttcttttagcttatctgcggcaactttctttgtagctcctacaatggcctgttcatcgagtattttataaacaaggtcttcttttttgtatgagtctgctttttttatgcctaactctttggcaataacttgaagttccgacagatttttgtcgtttaattggataatgttatacatatagtatggtaagttattaatatttctttttttgctgaattatggacagcattactacagctcatggctacagatatgcgagcatacgttttgttttttattctgaattagggatgtatatgttgaatcgtagaatgtttcaacggggcaaagataataattttttttggtttcatgaacaatcaaacatttttttccacgtaaaagtgtatctttgctacataaaagaaaatagtatgacagtaaatgaagctcatttaatttatttttcgcctacacacacatctaaacaagttgcggaggcgattgttcacgggacgggcataaaaaatatttttcctatcaatgtgacgcagcagattgcggatgaaattgtgattcctacatcttctttggctattattgtagtgcctgtgtatggaggacatgtcgctcctttggcaatggaacgtttgcagtatatccgtggagtggatactcctaccgttttggtagtggtttacggaaatcgcgcttatgaaaaagctttaatggaattggatgcttttgctattcctcatggatttaaagtaattgccggggcaacttttattggagaacattcatatagtaccgacaaatacccgattgcagtgggacgtcctgatgaatcggatttagcctttgctgcggagtttgggaagaaaatcatggaaaaaatacagacagctgatagtatggataccctttatccggtggatgtacgtactatcaaacgtccgagtcaaccattctttcctttgttccgttttttgaggaaagtcatcaagttacgtaaaagtggtacaccgcttccccgcgttccttgggtggaagatgaggatttgtgtacccattgcgggttatgtgtggtccgttgtccggcaggggctataacgaaaggggatgagctacatacggatgaggctaaatgtatcaaatgttgcgcttgtgtaaaagcttgcgttaggaaagcaagggtgtatgaaactccttttgcagctttgttatcagattgtttcaagaaacagaagttacctcagactattttgtaaatcacgacgcgcttagtcgtttcatcaatacgaaagcggttgtctgttcgttcgcctatcagccatgcgatgtgttctccacagcagagtacccattggcgttctttttggctgatagaaaatttgcggtcggtcagataatcgcttatttttttctttcctttcattccaaaaggaataaaagtgtctcccggctgccatttccggtaatgaatttctccattcagtttgtcggcatcaaaacaggcaatttccttttcacgtggaatgagaaaatccggggtgtattctttttcttctttgataatttgaaaaggaggaagagtctcattttcagattcagctgtttctattaataggaattctctgtcttttatcactctccattctttgctacagaattgcttgcccggttggctatgaagcgaatgggtgatatctttgatttgtgcggaattgaatcctagaggatgcaggacttcgaataagatggcttcgggtgccggttcctttactaaatcactgattcggataccttctgctgtaatgattttctttttagtttcctctatacatttattatatatagtggctatatcattcagataattactcgtatctatcagagtgtttttgactgacggattaatttcctgcatgaggggaaggaggttgagtcggattttattacgggtatattcgtcttccagattggtgctgtctgtcacataatcttgtccgatgttttgcaggtaacgaattatctcttcccggttgatacaaagcagagggcgtacgatggttccattacgggggcggattcctaacagaccggtaattcctgttccccgaatcaggttaagtagtatagtttctatgctatcatcctggtgatgggccacagcgacaacatctgcctgacattcttttctaattttctcgaaccattggtagcggagttcccgtgcggccatttcaatcgaaatatgtttttccgttgcatattgggtcgtgttgaaatcaatggtatgtaaatggatttccattctttcgcaaagttggcggacaaataactcgtcccggtctgactctttgcctcgcaggtggaaattacaatgtgcggcttcgcaatgatagcctgctgtatgcagaatatatagtaatgccaccgagtcggcaccaccactcaatgcgaccaggattttatcatccggtgagaataaatgttccttttctatatattttgtaacgcgttgttgtatcatacctgcaaagatacgagtttatcaataagtttttttattttttctgaatcttttagaggatgaaaaaagctgctatttaaaaacattctaaataatttgcatgctccgaagttatgaattatctttgccaaaaattttgagagttatgcgtttgtccgaattaaaaacaggagaaaaaggtgttattgtaaaggtattggggcacggtggttttcgtaaacgtattgtggagatgggcttcattaaaggtaaaacggttgaagtgctgttgaatgctccgctaaaagatcccataaaatataaagttttaggttatgaaatttctcttcgtcgtcaggaagctgaaatgatcgaagttatcagcgaagaggaagcaaagaaactggccgagaagaccgtttatcatgaaggattgcctgaagacctttcagtaaaagaagaagatatgaaacggttggcgttaggtaaacgccgtaccattaatgttgctttggtcggaaacccgaacagtggcaagacttctttatttaatcttgcatccggtgctcatgagcatgttggaaactacagcggcgtaaccgtggatgccaaagaaggttattttgatttcgaaggctatcatttccgtattgtcgatttgccgggaacttattctttgtctgcttatacgccggaagaaatctatgtgcgtcgtcatattatcgatgaaactccggacgtgattattaatgtagtcgattcctctaatctggagcgaaacttatatctgactactcaattgatagatatgaatgtccgcatggtggtagctctgaatatttatgatgagttggaagccagtggaaatacattggattatcatctgttgagtaagttgttcggggtgccgatgttgcctactgtcagtaagaaaaatcgtggattggataccttgtttcatgttgttatcaatctgtatgaaggagtagacttctttgataaacagggaaatatgaatccggaagttcttaaggatttgaccgaatggcatgattctctggaagatcgtaagaaccacgaggaagagcatttggaagattatgtacgtgaacataaaaagacggggcgtgtcttccggcatattcatatcaatcatggtcctgatatcgaaaaagcgattgaagctgtaaaaagtgaagtgtccaaaaacgaatttatccgtcataaatattctacccgtttcctatccattaaattgttggagaatgatcctgacattgagcgcattgtgcggacattaccaaatgcggatgagatattccatgtccgtgataagatgtcgaagcgtgttcaggacacaatgaatgaggattgtgaatcggctattacggatgctaaatatggatttatcagtggtgcactgaaggagacattcacagataatcacttggagcaggcgcagacaacaaaagtgctggattcgatcgtaactcaccgtgtctggggatttcctattttcttcctttttatgtatctgatgtttgagggtacgtttgtcattggagaatatccgatgatggggattgaatggcttgtcgagcagattggtgacttgttacgcaataatatggcggaaggtccatttaaagatttgctgattgatggaattattggtggggtaggagcggttattgtctttttgccgaatatcttgattttgtatttctgcatttctcttatggaagattcgggttatatggctcgtgcagcttttatcatggataaaatcatgcataaaatgggattgcacggaaaatcattcattcctttgattatgggatttggatgcaatgtacctgctattatagcttcccgtactattgagaaccggaagagccgtcttattacaatgttggtaaatcctttgatgtcttgcagtgcgcgtctgccaatttatttattgttggtgggtgctttcttcccgaacaatgcaagtctggtgttgttaagtatttatgtgattggtattgtactggctgtggtaatggcccgcttgtttagcaagtttctggtgaagggtgatgatactccatttgtgatggaacttccaccttaccggatgccgacagcaaaatcgatcttccgtcacacatgggaaaagggagcgcagtatttgaaaaagatgggaggcattattatgattgcttctattataatctggttcttggggtattatccgaatcatgatgcttatgaaacagttgccgagcagcaggaaaattcttatatcggccagttgggacgtggtatagagccagttataaaaccactgggatttgattggaaactaggtattggcttgctttccggtgtgggagcgaaagaattggtagtaagtacattaggtgtcttatatgcagatgatccggatgctgattcagtaagtttggcagaacgaattccgattactccattggttgctttctgttatatgttgtttgtattgatttacttcccgtgtattgcggcgatagcggctataaaacaggagtcgggtagttggaaatgggcgctttttgctgcttgttacacaacgggattggcttggcttgtatcatttgctgtttatcagattggaggattgtttgtatgaataattggcaagattgggtagtcggagtactggttgtactctgcattgcccgcgtcatatatggaatatttcgtttttttcgtcgtacgcgagaaaatcagaatccttgtgacagctgtgtaagtggctgtgaactaaaggatatgatggacaagaaacgtggagagtgcgatgtaaagaaaaaaagtacaaagaaaaaatgctgcggatagttggtagtttcaaaatttgtactacctttgcaaccgcaaacgagaaataatggttccttggatgagtggcttagtcagcggtctgcaaaaccgtgtacggcggttcgaatccgccaggaacctcaagtaacactttgaattccttgaaagtcaagtactttcaaggaatttctttttggggggaccattctggggaccaattaggtagtatattatggatataccgttactgcatgcgctaatcctttttattttaggtttttccctactgacaattatggaattcacttattaattctgattttcctgcgttacttttgttctaaaccaaaagaaaaacgccatgaaaaagattttatttatcctgtttgttgcccagtttattttggctccttatataataaagggctatggtgcaaatcttgttgaagataattatgagtattcgggagttgaccaagggagagagactgttgaaaaggatattttaggtaatatcattatccgtgatgataatggtaatagaaagactattgaaaaggatatcttagggaatatcatcattcgtgatgataaaggcaatagaaagactattgaaaaggatattttggggaacatcattatccgtgatgatagaggcaatagaacgactatcgaagaggatattttaggaaatttcattgttcgtgatgataaaggtaataggaagactattgaagaagatattctaggaaataccattatccgggacgataagggtaatagaaaaactatagagaaagatattctgggaaatactattattcgcgatgacaaaggtaatagaaagacgattacaaaagatatctttgggaatactattatcgaggatgataaggggaatagaacaactattaaaaaagatatttttggaaacgaaataattgaatatggtaacggtcatgggaaaattattaaaaaggatatttttggaaatacagtcattgaggagtattaaaatgtactttttaaaatgataatatatgggatgtcatttgagataggggttattcacaatatcgtggatagccccttattgtatgttataacctggcaataatatgttcgctataaaatcatattataatcgtaaaagtgtatatatttgcatagtgcggagataaaatatttatttctaagttattcaaggataaagaaatggaacacaaacaattactaactgtatttaattcacttcctgttggaataggtttcttcacagccgatggcactctggtaagatgcaatgaaagcttctgccgaatttttggcgctgactcgcaaacgcttcttggtaataaactcaacataaatgaaaattctgtggttcctgacgtggtgaaggaagcagttcgtcgttgtgttccggtacagatgagttttttgtatgatttcgataaacagagaaccgataaacgttttttctctacgcgtacccggacctgctatttgaaatgtaatggtaatcctctttatgataatgatggcaagtttgttaattacatttttatctttgaagatattacagaaacggtgaaaagtgaagaggtactccgtcaaagtcgccggaaaacggagcttgctatgaaggcagccaacatcatgttttgggaatttgatgcagtgcccaaattattttatagtgataatgaaccgctgaatggatacgatcagtctaagccagttagtatggcactatatctggagactttgcatccggatgaccgtagtcaggttactgaagtaatggaaagaatgagcaatggggaagatttttctttttcttttgatagcagggttatgttaccggatagctcaacctggcaattttgtacgataagcggtgctccttatgaatttgattctaataagaaggtattgaaatatgttggtacccgaaagaataatacggaggtgcagaaaaaggagcagttcttctataatatattaaataatcttccgttatctgttcatatcaaagatgtagagaatgatttccgctatgttttttgcaatgaagagagtaagctcatgtttggtaccagcgaagataaaactacttatgatgtgctgagtgaagaagaagtagagcgtattcagaagactgatttagaggtatacaatactgggaacccttatttcggcatggaacgtattatactgaaggatggatgcagctatgatactattgttcgcaaaagtataattgaagatgatggcaaacgctttctgttaaatacccgctgggatcagagtttacaaaatgaactgaagcgtcgtgcacagctgttaactgtcactatggaagcgatgaatgccttcacctggttttttgagccggctaagaacagggtgagtttcggtgaaggttttgataaaaatgggaagaaggcatcagaaattaattcggtcgagaaatatctgactctcgtacatcctgatgaccgacaaaagtttgctgaaactttgcaaaaggcggtagaactaggaagcggtgtatgggatgtggaatatcgcattgactttaaaggagatggcatgtatcaatggtgggaaacgcgtggccttgttgaaaccacaactttgaacgatgctccttataagtatttgttcggtatgacgcaaaatatcgattcctataagcagactgaattgaccttactaaagaataaagaaatacaggacgctttggtacgacagaatgaactggttcttaacaatacgaattcagggttggcctacatcacgaaggaatatatggttcaatgggaaaatatttcgttatgttcaaaaagtctttcttttgaagcctacaaaaaaggtgaactttgctataaaagtacatataatcgtacttctccctgtgaaaattgtgtgatgcaacgtgcttttgtttcattacagacggaacagatgaagttttcgttggacagtgcgcataccgttgaagtgtttgccactcccgtagttcttgaagatggatctgtggatggtgttgtaattcgcgtggatgatgtaacggagcgtgaaaaaatgattaaggaattgcaggaagccaaacatcaggcagagcagtctgataaattgaaatctgcgttcctggcgaatatgagtcatgaaatccgtactcccttgaatgctattgtaggtttttcggagttgatggcttatgccggagaagaagaaaaggcggactatatccagattattaatagtaataatgagttattgctaaaactgataaatgatatacttgatttatccaagctggaagccggttcggtagaactgaaatacgaaccgttcgacttatccgaacattttgaaaacatgtttacttccatgaagcagcgcctgaagaatccggatatcgtgttaactgaaatcaatccttatcactgttgtcaggtaactctggaccgtaatcgcgtggcacaaattataacgaattatgtcactaatgctatcaaatatacttcaaaaggttctattaaaatgggatatgcatgtaaggatggaggcgtctatttttatgtgaaagataccggtattggtatagctgatgataaaaaaggaaaagtattccagcgttttgagaaacttgatgagtttgcccaaggtaccggacttggactttctatttgcaaggcaattgcagaagctatgggaggtaaagtcggctttgaatcggtacacaatgaaggatcgctgttttgggcatttttaccttgtgaagtcgatacactttctatggtagaagagaagaaagaagagaatatctccggaggagagtttggtgcgaatgacgaagtgatggagaagagtgccggtcggaaaacaattctcatagctgaagatatacaaagtaattatcagctggtgtctactatcctgaaggatcattatgatttactgcatgcggagaatgggcaaaaggcagtggaaatagcgcgtagccaacatgtcgatttgttgttgatggatatgaaaatgcctgtactggatggattgaaggctacagctgaaatacgtaagtttaatgctagcttacctatcgtcgcacttaccgcccatgctttcgattctgaccggattgctgcaataaaggtcggctgtaatgaatatctggttaagccgcttgaaaaaatgaaattaatggtggcattaaagaaatatttataatctttgcattgtgaatatctggaattagttgaatatatcgatgaatcgtattaaaggtatactttatgcggcggtatcctcctccacttttgggctggctccgtttttttctataactctgttgttagctggtttttcggctttcgaggtgctttcttatcgttggggagtggctgctattgtattgacactgtttggatggtgttcgggatgtaatttccggctggcaaagaaagatttgttagtcgttttttttattaagtttgttgcgggcaaccacctcattcagtttgctcattgcctatcagaatatagccacgggggtagcatcgactattcattttatgtatccgttggctgtatcattggcaatgatgtttttctttcatgaaaagaaatctcttttggtgatgcttgctgttttaatgtctttgtttggtgctgctttactgtcatcgggagagttggaggcgaaaagttgtgatacaatagtaggattggtggcggcttgtatttctgtcttttcttacggaggatacatcattggggttcgaacaacacgagccgctcaaatcaattccactgtactgacatgttatgttatggggatgggagctgttctctatctgataggagctatggcaactttcgggcttcatctggtgacagacggttatatatggctgattattttaggacttgcattgccggctacggctatttccaatataactttggtacgggcaattaagtatgcgggacctacactgacttctattttaggtgcgatggaaccactgacagccgttgtgatcggtgtctttgtttttaaagaactgtttaccctgaatagtgttattggaattcttttgattttgttggctgtgggtatggtagtatttcgtaagcaaaaatcttaaagaagatattaataaaaaatgctgcttatctgatgtgataaacagcattcattctggagagcctcttgtcggattcgaaccaacgaccccgagattacaaatcacgtgctctggccaactgagctaaagaggcgtttttcttttgcgggtgcaaaggtatgaatttcttttaaaaatgcaaatacatcgcatactttttttatatttgcaaagttaccaatgattagatgaaaatgaaaattatgaatgtatgtagtgtggcgcttttagccataggtatatgggcttgttccggacagaagaaaggaacggcgaatgttgaagttgcaacagatagtgtagaagtaactgcggatgcaaaatcagttcaggcagatagtacaggatatattgttcgggtaggagagatggctccggatttcacaattaccttgacagatgggaagcaagtgagtttatcttcccttcgtggtaaagttgtcatgttgcagttcactgcaagctggtgtggagtttgccgtaaagaaatgccgtttatcgagaaggatatttggttgaagcataaaaataatgcagactttgctctgattggcattgaccgtgacgaaccgcttgacaaagtactggcttttgcaaaatctaccggagtcacttatccgttaggactggatccgggagctgatatctttgcgaaatatgcattacgtgaatccggaataacgagaaacgtgttgattgataaggaaggaaaaattgtaaagctgactcgtttatataatgaggaagagtttgcttctcttgtgcaggcaattaatgaaatgctgaaataaaagagaaccttcatcagatatttccaacggaacatatatgagtatataaaaatagtaacgctatcctgatgtgatggcgttactattttggttatatagtgacgctatccggagtacataccgtcactatatgatgatgcattttcaagcaatgctaagtttgaccaggtaatcgtaatgctttccttcttttatcaattctgacttaaaaccacattcggaagcatataagctaagagtctggaaatctacatataaccagtcgaatgtgtctccttttacatctttatattgcatttggaagtcgatctctccgtagtaatctccggccagatcgatgactatgctaccgtcttcctcttcaaaaagataacgcaaatcactggaatccataaatatgcatccaccggggcggagaatacgtttcatccgttggaaaaattcgggcatattattcagccgtccgatgattccggaaccattcatgagcattaggatcgtatcgaatgtttcggaaaatgtttcatcaaaaaggttgatgagacgaggatcgttcactccacgttgtttcattacttcgacagataaaggagaaatatcaatggcgcatacgtcttttcccatttcctgaagtgcgagcgcatggcaaccacttccggcacctacatccaaaatccgtccagtagccatttgcagggcggtgcgctctagtacaggcatagactgtatacgacgaaacagttctttgacgggaatttcatcttcttcgaattgagaagaaaatacccgcaaacgatcagctctatgatggttgaaatagtcagaaatagcggctcccatcgggtccttttctgcagaaagaattgttattgccattggtggttacgattgttaactttgcaaagataaataaatccgtagaaaagggttatctttgccatcggaaatgttgaatactaataaatgattatatgagtatagaagaagcaatcatgggtggcatcgtttttaaaggtaagaaagataagcccaaagaagaggaaaaggtgaaaacgaaagcgaaaaaagcgacgtatattcgtggacaacatggttcgggtgcagcgaagatgaaagcagatatccggaagaaaagagctagccgacataaaaaataaaggctgtagcaataaacggatcatcaatccggttgccttttagtcattgaggagtggcttttttctgattaagcaactggcaaggtggtgtttattttcggatacatatttatagtatttgttgttttaggtatatatactatgtgtttgatagatcatatattctacataaaaagtgggggcaggataattatcctgcccccactttttatgtaaaatcacttctgtggaagtatttcaatccagtaatcatccgggtcattaatgaaataaagccccatggcagtgttctcaaaacatacacaattcatttctttgtgataggccctgattgcatcgtaatcaccggctacacgaaaacataggtgactttcgttttcccccagttcgtatggagcagtatgatctttgagccatgtcaattccaataggaaaccagtttcattatctgtcaggtaaaccagtgtgaatgaaccgtcggatgcttctttccgatgatgttcttttaagccgagtgctttctcataaaaagcgatactccgctccaggtttgtaacgttgatattaaaatggtcaaatttactttttatttccattgttgcaattttccttattttttcattaagagtttcacaatttctccaacataggtacggggttgtccggcttgcggagttgtctgtgaaggcattttcttacattcgataacagctgaaggagttgtctggttcggagcatacaatttcagtgtatagctgtctgccttttctatagcatcataaggttggtcgggtgaaagtgtgcaatatgcaacagcttttcctgattgataacctaatgcaccacctgcatttgcagtcatattggtcatgttgaactcatcttttccaatactgattactaatttaccacttcccattaaggcatatacttcgcccggaatttgtttcaaatcaatttctgtataaccggatgcatcggatgcaactttggtagccggagtggcaggagtcaaagtagccgcaggaatggtggtttgagcagattcggtagtggtaactttacctccctgaccgataacgatcgggccggcagcggccacaacagatggtttttgttgctcttcttctttcttctttttctctgtcttcggacgagtatcaggtgctccgaaagctactgctacatccataaacatatcatctgcgaagtctacagtttttctacgccatttagccaggccgcgcactaatttggtctttgctttattgagcgcatatttatcagtaatccattcttccgctttgtatttctctgtttcgcgataagtgaaacggattttctcaagctctactaggcagttgccgggtttacaggtaacggtaatctgatagttgaccagtgtacggtctaatgacagagcactggaactgaaaacaatccattcttctccaacaccggcaattgttccctttgcttcgtcagagaaaacaatgcggctatcaatatttttattttctttcagacgttcgtccatccactttgtcattgtgtcgtagatttgtgcctgactcattccgggaatctggaactctttggaaaatactactttaccatctacttcaggaacagctcctacaaggtacctggtgtcatctttcttctcttttgcagaatctgccttcatcgccatcggcaatgcaaggaacagggtaagaaacagaatcgtaaatttattcataattatcatgtgtttatttggtaatctcaaaactttcgccccgatgggtgatgctgataaaacggcatccggcattttcagcaaaactacgaagcgcatttcccccctcataatcttcactgaagtgcatgggcacaaatatagtagtttttatttgttcgatgaactgttttgcccctttcatgtaatcttttcccattctccgatccaccgggaatagcactagatcgatgttaggcactttttcttttaaatatttaacttctgcaagaaaatcaccattggcttttcgtatctcttcttcggtcgattcttcactccagtgccagttgttcaagtcgccggcatggaagatactccaatcttgtaagtgaagaaggaacgaactgccgatatctgtcgatccgaaggcgtcgatgcggatcgtgtcgtcttcgtaggtttctccttttttaatatagaaagcatcttcggctttggcacgatgggacttcagaatatctttggagaagatgtattgaatgtcggggcgttgctctttccaagtcaatatttcacggttaaagtgatcgggatggaaatgagtagccaatacgtacagtttacccggcctttgcaggagataatcatgcacgattccccggttgtgttccgtttcggaagaatctttgtagtaatcgatgataacggttacaccttccatttcgatggcgaaaccgctgtgataaatataatccagtgtcataagctgactattttatagttgcaatattacgtattctcgttggagttgccaagaaaaatcgacgaaatcaaggagcaagacgactgattttccattcaccgtccggttgcagagtatatagaaaacggtcatgcagacggttggggcgtccttgccagaattcaatccttgtaggggtaacggcatatccgccccaattatcaggtctctccacttcttttccaatccatcgggcagcttctctgacgaaggatcgtatcaattgcattctgcttgctatcggttgactttgtggagaaattcgtgcgccaatccggcttttataaggacgtttccggaagtattcatccgattcttccggtgaaactttcgtcgctatcccttctatatgtatttgtctttcgagggcgtgccagacaaaagagagggagatggatgggttttgtgctaattgtctgcctttgcggctttcgtaattggtataaaagacaaattttccatcatggagtccttttaacaatactgtacgtgtggacggtctcccttcgggggatacagttcctacaatgaccgcagtcggttcgtccacctctgcgtcaatcgcttcttgcagccaacgactgaaaagcgaaagcgggtcgccgggaagttcactttcccgcaacccgcctttcgtatattcctgtcggatatctgctatgtttaatttcgccataagattatctggcagctttagtttattatttttaatgatgatatcacataggtacttctattaatagaatatgtgagtctttcaatgtctccagttcaacgctgttcgtatcataaacacccatgccgtcacgacgtttcaacacttcaccgtctactactatttctccttcaatgaggaagatatagacgcctgcatggctttgatgcatgtgataacctaatttccttccggcttctactttgccgatggagaaccaggtatcttgcaaaagggaagcaggtgtgctaccgtcgggagatacgatgactgccagttcgttcggacgctccagttctgcaatgctgaaatcctgataaacaggacgggtgttccgttctctcggcataatccaaatctgcaggaattccaccggttctaccggacttgcattaacttcactatggaagattcctgttcccgcactcattgtctgaatttctccgacagtaataatgcggctgttcttcttgctgtctccatgttgcagatgtcctttcagaggaatggaaatgatttccatattcttatgcgggtgagtctgaaaaccttgtccgggcgcaaccttatcatcattcaatacgcgaagagcaccaaaattgatacgattggagtcgaagtactcgtcaaaactgaaagtgtgataactatccagccaatcatactgggaatgccctcttgtatctgctttatgtattacttttttcataaaaactgtcctttctcttatttgtttatatatttgataaacaaagaaagcggcttaaaagttttatttcttcacttcatttaataaaggcttgtgattgataaaatcttttatgttttgcagggtggtcgcagcaatattctccatcgcttcatgtgtgaaaaaagcttgatgagaagtgacgataacattgttgaatgaaagtaagcgggcgagtacatcatcgtcgataatacggtcggattgatcttcgtagaagtattcactttcttcctcgtatacgtccagtcctgcggaacctattttcttgttcttcagtccttcaatcagcgcattggtatgaatcagttgtccgcgaccggtattgataatcattactccgtctttcattttgctgatagagtagtcgtttatcaggtatttggtctcttcagtgagcggacagtgtaaggagataatatccgaattgtggtataattcgtctagtgaagtataaacaatttgttcttgacgggcgaagttgtagtccggatagaggtcataagccagtacgttcattccgaacccttttaagatgtgaatcagtattttcgctatttttcctgtgccgatgatacctgctgttttcccgtgcatatcgaatcccatcagaccgtgcagggagaaattaccgtctttggtacgccaggaggcgcggggtattttgcggtttagcgatagcataagtgctaccgtgtattctgcaacagcatagggagaataggcgggaacccgcactacggtgattccggcagcggcggcagcatttaaatctacattattaaatccggcacagcgtaatgccagtagtttcactccgtttgccgccatcacatggattacttctgcgtcggcaacgtcgttcacaaagatgcagactgcatccactccttgtgtcagaagtacgttgtttttattcagatgtcctttgtaatagcgtatttcaaatccaaactctttgtttttatcattgaaagaggactcgtcataaggctttgtgccgaaaaatgcgattgtataggccataatattttcagtttttattgcttactagtaaacgctaaaatagggtgaattgtttatcctttttgggggtataaatatggattgtttcattagaaacagtttactttttcaattaaaataggaggcaaaacgaaaataaatgcacaaacgtatctctcgtgtgcaataatatcgtatctttgcgcccgaaataattaaaaaaagatttagatgagaaaaatttccttgattggatttgtaatgctaatcgtttcaattccaacttttgccggaggtcttctgacaaatactaatcaacacgctgcttttcttcgtatgctatctcgtggtgctacctttgaaatagacggagctttgtccaatcctgccggtttggcttttttgccaaacgatggtttccatatgggattgagtattcagagtgcctttcagacgagaaatattgatgctagctttatgacatatagtggtcttgatttatcaaatcctgccgctcctgtccctaccgtttccgaccagccttatagtaagtattataaaggaaaagctgccgcaccggttattcccagtgtgtttgccgcatataagaagggagattggactatttccggcttcttcgctataactgccggaggtggaaaggcttcatttgatgacggtctacctatatttgagtcggctgctatggcaaaaatattccaaaagagtttggatggagtagcgcaaggagggccgataatgactccggacaaatatatcatcaatagtgctatggatggcagacaatacatctattccttgcagttgggtttatcttataaaataactgattggctttcggcttttgccggtgcccgtatgaattatttttcaggaggttatgagggattcctggatgctaaagtgggagatacagacttaatgaatttggctttggactgtgaccagacaggttggggattaactccggtgataggcgtggatgtaaaatggaacaagttgaacattggagctaagtatgagttcaaggctaacatgaatattgaaaataaaactcataaattggactatcctgccgaagctgaagctttgataggcaactataaaaacggtgtcaatactccgaatgatattccttccatgctttcggtagcagtggcttatgagtttcttccagtactgcgtgcatctgtagaatatcacttttatgatgataagaaagcaggtatggcagatggcaagcagaagtttttgactaaggggactaacgaatatctggcaggtattgaatgggatgtgaccaaacaattgtcgttaagttgtggtggacaaattacggattacggattgtccgataactttcagagcgataccagtttttcttgcgattcctatacattaggcttcggggcgaaggtgaaattgagtgagagagcagctttgaatgtgggttatatgtggactacttacgaagattataagaaagaattctcaaattataatggtacaggattacgtggtaccaatgtatatagtcgtaccaacaaagtatttggtcttagcattgactacagattttaaatagattcgatctttatagaaaaaccaagttaataatgatagggggagatagcatttcaaatgctgtcccccttttcttttttataccataaaataatcttttaatctagaaagtttgcgtatctcaggatattttgcgaatattgtcccaagttagcattaaacgagatacgaagaaatgtagtttagtttttaggacttgacttaaaaacccagtttatgactctcgacgatcaaaagcacataataagtttatggatacaatttttggatggaaatgaaaatgcattttcccaattgtattgtctgtttcttgatgatttgttaacttatggtcgtagagttgggggagataatgaaatggtagaagacctgattcaagatttgtttttgaagctttatcagaaaaagataattcttgaggataatacgagattgcgcccttttctgtttcgagcattaaaaaatttgatttataaccaactacttcgtaatgcgaaacttcaaccgttgccggactatgacttcgcttttgatttgaattatacgattgatgaacaactatctttaacgcaagaccaaggattatcagatgaaattcatcacattttaaaagggcttaccggacgtcagaaagagattatttatcttcgctttgtgcatgaaatgagttttgaagaaatatcagagataatggagattaatattcagtcagcaaggaatcttttaacccgttctatggagaaactcaggaaagaagtttcatctactactattttatttttcatttatatgatttctatataattgtattacagattattataatatgcttctcgttatttttcattctgctgattattttctttgaaaaaaaacatttcctatgagtataaaatcatcggttcatttgtcatagtagaaaataaagcagaaaatggctcaatttacttataaagatatagaagaattcttattggatgatgattttttccaatgggcaagatacggttcttctgataatggatttaatcttgaatcctataaacttcagcatcccggttgcgaagaaaagatagaattggctgttgcaatggttcgcagtatgaaagtggtggaaaatagtaaacctacttcccgggaatataagatgcaaagcttcaacaaaatgatgagtaaacttcaacagcaaccttcacagccagtacagtcttatagaaaaacatttccttaccggagaattatgacttacgtggcaagtgtggcagccttattgtttgtctgtttgggaacttattatgttctatccagatcaggattacaggaaactaccgatgttacagtccatataattgattctttaagtcattcaggacaagtacaaattatcttagatggtaaacaagcagtcactttggataaaaataatgctgaaattcgggtggatgaagatggtgcagtaacagtggacaaacaattggttgctgcttccaaaggaaataaagtctcggtgaaccagatagtagtgccttatggaaagcgttccaaaataattcttccggatggttcttcattatggataaactccggatcatgtatttcttactcttcagattttgtggcaaaaagaaaactgaatgtacaaggagaggtttatttggatgtccggaaagatgctgcgcacccttttgtggtaaaaacgaaccgtttggaagttaccgtactaggtacttcattcaatgtaactgattatgcaaaagatactgaaacggcagttgttcttgttcagggaagtgtagatgtaaaagtggacaataaagaaaaaaaacgtttggttcccaaccagcgtctctctaaagagaatggtgtggtaaaagtggatgaagtagatgtatataattacatttgctggaaagatgatgcaatgaacttcgacgggcagaaactctctgatgttttgaaatcactatcgagatattataacacaaaaatagaaatatcaggaagcttgaaagatgaaaaatattatggaagccttgatttaaactgtacacttgatgaagtgttggaatccatctcattggctacgccattaagtataatcaggcaaggagatgagatatacatcacgcctgaaaaatcaaaatgaagtataaccttttaaaaagtaagaaatgaaaaacatacccccttaaaaagaacaaaccggataatatctgcgaaatatcatccggttcaaattagaactgaacataactcaccaaagttataaccaatctaacaatacaaaaatatgaaaaataactctcaaataagggctaaaagtaaatatttaaccaatattgggcttcgatttttacttttatgcattcttttaacgtcttatttgccgaaggtttcggcagaagacggatttatgctccttcagtccacgaatgttacattgaacttgacgaatgtttctttagagactttgtttaaaacattggaaagaaagagtaattacgttttcttctttaaagaaaatgttcttcaagaaaacgaaaaagtaacagtcaaagcacaaaacgagtcagttgtatctattttgaatagaatattgcctccaagacaactgacatatacagtaaaaggaagacaagtgattattgtccgccttccccgaaaagaagaaagaaaatcagaaacacctgtagaatttaaagaatacactgtaaaaggaacagtcattgatgctaccggacaaccgttgccgggagttaatataaccgtacagggtactactcaaggagcgacaaccgatctttccggttcgtttacactacagataaaagatagcaaacgcgttctgcttgtcgcatcctatattggtttttccacaaagaaagtctgggtgtcgggtgagactcattctttgaagatcatgcttgaagaaagctcggcatctttgaatgaagtggtagttgtaggttatggtacgcagaaaaagctgaatctgacaggagccgtaacaactgcttccggtgaaattcttgaaaatcgtcctattggtaatattgctcaaggacttcagggtatggttcctaatctaaatataactttcaatagcggccagccgaatcaagctgccaagattaatatccgtggtaatacatctttgaatggcggtaatgctttgattttagtagatggggttgaaatatccgatttgtcattggttaatccgcaagatgtagaaagcgtttcagttctgaaagatgcttccgcggctgctgtatacggagcgcgtgcagctttcggtgtgatgcttgttactactaaaaaaggaaagcgtaatcagaagacacgggtgacttatagcaataacctttcatggagctcacctgcccgtttaccggagatgccccgttcggatgtctgggcacgtatgtggaataagatttctgattatgattctccgggaagctattattttaatgagaagtttatgaaggctttggatgcgcacattgctgacccggaacataatccggcaattctggtcgatacggaaggaatacagcattccagctatactcccgcaactccggggtgggcctatgtcggaaacacagactggctggatgagttctatagaaagtctgcttttatgcaacagcataatgccagtctttcaggtggcacagaacgcaacaactattatgcttctatcggttataaagaccagtccggtatttttcgttatggcaatgattcgtacaaacgttttaatctgtcgttcaacttcgataccaagattactgactggctggatatgagcttctccactcgaatgagtaatataaagaatgatgaaccatatatggacaatggaggatcggatgcggtaacctggtattatgaagtatatcgtatgtatcccacattatctgtctttcttccgaatggtgattttgcaggtatttatttaaatggtggaaattataacatcataggtaagatggcccttgccggtcgcaataaaaaagaaacctgggaccaatggtataccggacgttttgaccttcatccgatgaaaggtttgtccgttaaaggtgattattcatggaatcgttattccactgtccagaagttccatcgtaaggaaatgacacagacgtttccggaaggaagagacccttatttagtggagacgcctaactatgtgagaaattataattcgaacaatatttatcaggcaatcaatgtatgggctgaatataagaaatctttcaatgatgttcataatctttctttaatggccggttacaatcaggaagaaaaaacatacgcttccacttcatataccatgacagatttgtatgataatgaaatgcctatatccgatcttgccatcaactataaagaaaatgaagaaggatctgatatatggagggtacaaggtgcttttttccggttgaactacgattatcgctccaaatatttgttggaggtgaacggacgttatgacggttcttccaaatatgccaaacatgaccgttgggcttttttcccttccgcttctgtagggtggcgtatttctgaagagaaatttttcaaatcattgagcaaagtggtcgataatctaaaaataagagcttctattggtgctttaggaaatcagattactgacggtaaccattctttcatgtctatcatttcaggtaaggtacttactaattatatgatggatggtaagattgtgaatgggttgaatatacctactctgcctagtatggttacttgggagaaagttataacaaaagatatcgggttggactggtcgttgtttaaaaaccgtctgtttggttcgttcgacttttacgtgcgtgatacgaaagatatggtacgttccgtaacgttgcctgctgtattgggaacttccggtggtaaggagaatatagcagatatgagaaccgttggctgggaattggaaatgacttggaaagaccggatacagaatgtactaggcagtccgttggactactcactcacagtcggattgtctgattatcaggcagaaataaccaagtatgataatccgaacggctcgttggcttccggtatgtatcataaaggacagaagttgggtgaaatctggggatatgtgacagatggatatattcaggacgattttgaggctgcgaagatgaattacctacagaagtttatttcgagcaaatggtatccgggagatattcgttataaagatttgaatggagatggtattattgataaaggcaaagtgacgttggacaatccgggtgaccagaaagtgataggtaattctaccccgcgctatcgttttaatctgcaaggaggaattggttggcatggttttgatatacgtgctattttcgaaggtgtaatgaaacgggatttgtggacgggaagtgatgtcttttggggattttcccgaggaatatataactctaatgttacccaatatcatatagataatacgtggacttatgaaaatccgactgcttattaccctcgtcccaatacagatggaaatggcaggagcaggcaggtacagacaaaatatttgcagaatgccgcttatatccgtttaaaggatattacccttagttataatatacctaggaagtggttgtctaagttaaaaatggagcaaatccgtgtttatgtcagcggcatgaatttgtgggagaagacaggattaccaccttttatgactccggatattgtggaccagataacaagtgagggcgtaagtttacaaagcgaaaatgccggtaagcaatacgcttttatgagaagctattcattcgggataaatattacattttaatataatcagctactatgaaacagtatataatttcatttatttgtttttcatgtctccttttgtccggatgtaattatctggatacggaacccggtgatgccatctccggtgattatttctgggaaactgcgaatgctgctgccttggagcaatattgcaatttatattatccaaagctgattaaaggacatggagaccctctgtcgtggaatgtgggtgctatgattatggccgattatcaatctgataatatattagtgtcaggaggtagtagcattacgtatggtcagaataccaaattgacgagcaactcagattggaattggtcaacggtgagaggctgtaatagttttttgcagaactatcagcgatctccggcttcggaaatggataagaagaagtatgccggtgaaatcttatttttcaaagcattcgattattataataaagtgcgtctttttggagatgtgccctggtatgatacagcattggacaaagatgacccagatttatataagggacgtgattcgcgaatagtagtgatggcttctattttgaagacgattaaccaggctattgaatttttgcctcgtaaaacgaaggtatatcgggtcagtcgtgatgcagctttattgttgaaagcgcgtatttgcctgtatgaaggaacctggaggcgctatcgtgatatggaaggagatgtggaatatctgaaagaggcttataatgctgccggagaactgatggattatggatattctttatataaagcttccgctacgggcgaaaattatttcgatctttttattcaggataattataatggcaatccggagattatcttgtctcgtgagtatgatccggctatcaatgagggacacaatgtttccagtggtattcctaatggtgagatgggaatgagtcgtgattgttttgaagagtatctctgctcgaatacagggaaacctatttctctttgtggttgccatcatcccaatatgggatataatgcagaaatgaagaatcgtgacgggcgtttgttacaaaccctttgtcttccggaaccgggcaggtatgcacgctatctatatcgtgaagacggtggttcgttaaaaggcggtgctcctaatatctatactatccttcctaactccgatacgcgaacgttttatggagcttcttgtacaggatattcaatatgcaaattttacaaagcatccgaatttttagttggaaatcataaaggaggcatcgatgctccggtaatgcggtatgccgaagccttgttgattcgtgctgaagcgggagctgaattgggtgaagatccggaactggataagacagtcaatgcgcttcgtgcccgtgccggttttactttcaaattggatgagaatccgttggaagatcctgatttagtggccaaatatcctgatataaaaggaccgaataaaaatctgatccgtgaaatccgtcgcgaacgtcgtgtcgagctttttgcggaaggttatcgttgggatgatgtttgccgttggaatgtaggagaaattgttttcaatcgtgtgcgtagaggagctaagatggatccggatttatatacgaccgatgaaattaagactattcgggaccaaatcgggttcgaccaggatgggtttattactccgtatgccaagaaaatcacctattctatgaattttaaggcgaagaactatttgtataatattccgttggatgaaatctccttgaatccgaacttgttgccacaaaatccgggatgggagtaattactgactcaattttaattaaagaataacagaagactatgaaatacaattatatgtatatacttaaaagtttacgtacctcattgctgttgatggtcatggtactttcatgcagttgttccaatgaagaaaattcagctccccataaaggggctactcttccgataatgcaaggaatagcagataatgtcccatacattcagtcggtagagaaagaggctgcttatgatcttcatgaagggattcatataaccgacgttacttttacatattgtgcacatcctacccgtatgttgatagcagagattgacttgactaaaaatgtaacgattgcagtttctactcctgataataaacccgaagtcgggatactaaaacaacaagtgaaagtgcaagcggaaaaggcggaggctagcgggagaaaagtgttgttaggaacgaatggtgattattattcgcagtcgaaaacggacgatacatggataccgggtggtttagtctataaagacggcgttgcgctttggactaaactgggatgggaagccgaccatgctttttatttgttggatgacggaacagcccatatcacgcctgttgaagagtttaatgctgtgaaagaccatgtccgggatgctctctccggttggcaacgtttgcttatagacggacagttggctggtaaattcacggttaatgataatgcgatgcagtttcatccccgtacatttgtcggagtatctaaagataataagaaggtatatctgtttgtgattgacggacgccaaccggaatattccaatggcatgcttctggaagacatgatgctgttatgtcagggagccgggtgttatcaggcattgaatcttgatggcggaggttctacaacgatggtgcgcagggtggaacaagcgggaagtcctgtctcttttgaaataatgaataccccttctgatgtaccatcgagagcagtattgaatggattgcaagtcattgaaaagaataactaaaagtagaatattatgagaaaatatattagtcctcactatttgttgagtggattattgggaatgctggcgcttgtcttgtccgtttcgtgtgacgacacagatgtggtgcgcagggtagatccccaaatagaagtacaggctgacctttttacgggtcctgccgcttcacggcaagtattgccgcttcattctacttatccatggtttgcagaagcgtctgcttcttggattaagttgcaacgttatcgtggacaggctttgctgccggactccattgttacggaaatagacgaaaatccaaacatggaaccgcgtgaaggctggattgaaatccgtctgatggaccagatgtctactcgtattgtagtcaagcagaatggacgtggttctcttatcactttacagaaaaaaataatttattttaatgtaaatggcggagaaacaatcttggatgtaataacggacaaggactggactaccgatgtacaacaggaagatgggtttacttttacgaagattgacaagaaccacttgaaagtaaaagttgctccgaatactacaggtcgtgaattgaagaaggtggtgacactaacagatacagagaagactataaaaactgaactgactgtcattcagactaacgtagagaaaatgttgtctatttcgttaacagaagctgataaagacagattggttgtcaaggctggtgaaaatatagatatgccggtttccttaaatgtcggctatgactgtgttgcgtccgaaagttggataaaagtattggcaactccaccgtttgaaggagatattgtacaggatatcatgataaagatagctatagatcccaatacaggagatgaagaacgtaatggatatattgtagtgaaaaattccggagacgttactgatgtttcggataccttatttatctcacaacgtgcttgtaatcagatagtctatgtgaaagcaggtgcatctggtgacggtacaagctgggaaagggctttcggtacagtagaagaggggctggcggcatgtacggattatggtagcatggagctttggatagcggaaggtgaatatcatttgaagagctggacttatcttaagaaaggagttaatacgtatggaggatttaatggtacggaaaataaactgaaagacagggatatgaccaagaaatctactcttgtcgctgcacctgccaatacctggccttcaatatatggtaatgttttgtctgccggtgttcattgctatgtggacggattcgtatttacaggttcaaatgttactcaaggagaaggttctgtggctttctggggtggttggattctaaggaattgtatgataagaaataataagtcttatagagatgccggtggtgctttctttaatgtaacgttgattaattgtttgatttgcaataatacgactgctgataacggatcggcaaaggcaacttcttctattgttaatgcgcaggagggtacgcgattgtataatgtgaccattgtgaataatgaaagtagcgggagcagtagtggcttgcgtataaatcgcggtgctgtatataattccgttatttggggcaatgtgcataaaatcggtacgaatcatcaaggatatttggatgtaaataagagcacccttttcgtaaataatgcaatacagggaggtcttgtctataatggtggaaatacgccaagttcaaccgaagggtgtatcatcttgaatgcgagcaatgcagctgccgacggacctggttttatggatgccggttcgggtgattatcagttgcagtctacttcgcctttgattgatgccggttcaaatccggcagttcaaagtgcttgggatattattggcaataagcgtatctggggtgagaaaatagacataggagcttttgaatacattacaaaagaatagtttcagataactataagaagagggcgatggtgccgatagattcagctactgtcgccctttttattaaagatacagatagctaaaggtgagtaaatgtgtggtattattataaaatatggaatggttattagtctgttgagctgcatcgctcatcaaactatggcacaatatgcagggaaagtttttgtcgatgaaaacaagaatggacttttcgacaaaggagaaaaattgttgcaagatgtatcagtctctgatggtttgaacgtagtgtctacagattcagatggcaccttcagactgccgggacatactcgtgcgcattttctttttataactactccttccggatataaaacggacaatgcatactatcgaccgatagagacgggacgtatggaatatgatttttctgtatatccttgtcggaatggtattctggcagatggaacccatcggtttatacatatttcagatacggagattcgtggaaaagaaggtaatcaagagtgggtagataatctttgtgattactcaaataatgagaaaatagcttttatcgtacatacaggagacatttgttatgaagcaggtttgaatagtcatattcaactgttgaatacgtctttaatggaagatacacaggtattctatggtatgggtaatcacgatttagtcaaaggaggttatggagaagagcttttcgagaagatttacggacccactttttattcttttgaagtaggaaatatacattatgtcatgactcccatgcttcatggggattattcgccttactatacgaaagaagatgtatatcattggttgaagaatgatttggctcatactgataagaggaaatctgtgattgtctttaatcatagtatatcagaagatacattgtcttttaagtatggtattagtgacacagaatatatagatctaccggcagccggtttgaaagcttggctatatggacattggcatgtgaaccaaatgtatagacatgaaccgacaggggtatatacgatttgtacgccttcgcctgcttgtgggggaatagatcatgcgctttcttctttccgggtgctgacagttgatgcgaaaggcggactgacttcagagttgcgctacagttatctctctccttttttgcatatcgtgtcattggaaaatgggcaggtacctgtgctgccttcgggcagtgtccccctatctgttaatgcttattatacagcatcgccaatacgttctatacgctattggtgtgaatatgagggacgaaaagtcgtatcggataagtttttggtacgtcaaagtgattttaattggtatgatgagattcccttgttttctcgatggaagaatcggcgaataacggtagtagttgaagcgattttcaataatggagaagtaaagcaaactagacgttcggttctatatggaaaacctatagaacaacagcagcgtttgaggttgacatgggttaaaaatataggtgcttccgtatatatgtctgctcctttggtttatcaagaatgtgttttcatggcctctgtggatgataatatgtcgggaaaagcatccgttgtgtgtatagatgctcagagtggaaccattcgttggcgatattcagttcgtggttcggtacgtagcagtatagctgcttctgaaggattggtttttgcccaggatgtatatggaaacttgtatgcgattgatgcggagaacggaacattggtttgggggaaaaatttgaggacaggaatactccctcctttggatgacggattggcagcggttggcaaagtgttgtatgcaggaacggggaaatcattgtatgcattccatgcacctactggtaaacaactttggaaaaatgaggcctggacaagaggagagggatgcgtggctacactttcttttggacagaatgttttgattgggcatgctaactggaaaggattatatgctaacgatgcgactaccggttgtttgttgtgggagaacaaagatgttgaactaatctatcgttcagcttcagttacttgggtggagaataacgtatatcttctttcttctcattcattgttcattttggatccgacaacaggaaagatcattttacgtaagaagttaggctgttcggtcgatgtgaattcaactcctttggttactgaatctgaaattatatttggaacagctaataatggaataatagctttagatcgtcagactttagatgaaaaatggcattttaaaacggggccatccttaatttattcatctccttattccataccaccgtcttccacagtggaaacaacacctgtattgatgggtgataccgtgtttatgggtgcttccgatggaatactctatgcgctgaaccgtacagatggtaagttagtggggagatttaaaacaggtgtccccatattctcttcggttgccgtattgggaaatgcattgtacgttgccgattttgcaggtaatgtatatagatttatattaaataaaggcagttatatacgactctacactagccctgtcgttataacttttggttataaaaaaactcttcctagtcggctataactgggaagagtctgtttctttaaacagatataaatttgaaaattcaaatcaaatctttatctttgcaataagacaatatgcttatcataatactatgtggataattggaaagggtctacataggtaggcttttgactataaatcaaaaactttttaattatgaaaaagcatatttgcaacaaagagaaaacggttgaggttgaaggttacattgctatacgtgaaaacaaagtagtatatgttgaacctcataaacgttgtcgccctactaacaagaagtaggctttgttgggagtcgcatttagaggatgcgactcttcttatttgacttcaaatataataaataacatctaatttacaaacataatatctgctaataatacttaatcacctccacttctgtctcatattcttttgattagcaaaaataaactgtactaaaataggtatataggtgtactcaaattagtacacctatcatataatataatcatataataaaacaaagaatataacatgaaagacatttttcaagcaaaatgcctattgattatttttcttttattttccaatttatttttgtataaagtgaaataaagaaaaatcctatcagacacatagatactatatctgttatcatagatatagttggtgaaatatttatgagtaggcaaataattgctacgattgcttttaataagcatcctataaatgctattaaagccgctgttttaaaatttgttattttcattttttagttatttgtttatttccatttatcaagatttcctttctgtatttctttctcaaataaacgataagctttccttgttttttccgctgcaccttttttgattttatagtcataatatccatcagtagtatatattctaacagcagtcattatgtggttcttaaaaacagacagatcacctaatagtaatatacggagtccccataagtccattcctaatgctcctactgttccttcccctcttcctgatgcatagtctgatactgtaaattcatgcggattatcttcttcatcaagaaatatcactttggaatttacacttactaatctcgcatctgccgttagccatttcatcaatatcatatttaagccattttcacgaccaaaacacattgcaatatttttccccgtttgagtaccaataaatgcttctgatgaaatcttttcataagacgtgtacacaactttgtcttttgtgaatttatcagtttggctaactttaatactttgagcttgaatgccgatgctaaacataaacaataatagaagtataatattctgtttcataatcatttcttgttgcatttaaatttagtgtatatcgtttcattatttaaagtgaactgtagttcacaatattcccaccataattcagttacataacatttaatgtattcttgttctcctacgtaaaaagttagatttcttttggacagatgccatgtacctgatacatttcctagataaccatttgttgaatatgaaccgtcaggtctgattgttaaagtaatctgtaaactcggatttttagaaactccaatccattcttcattttgtttcatttgttgtagtttccatgttcccatcaaagcatctttgtaaagattgtctcttgcacaactcgtacataatagaatagtgaagacaaaaaacggcaaatactttctcatacacttgtgttttattggttaatactaaataataatgtttccagtctattagcaataaccatacgccagtatatgaaaagacgcagataattgctccacgtcccttggctcaccacaagccattacacaccgagcaagaaatctgcgtctatgcggattcctcaacgtgtgtaatatataactcgttcattctcgaggtggtgattcagggacgattgagctattatatacataaaaagcgtaccatctattcgatgatacgctgcaaatataagaataacttcataaattacaaactgttagtccttcttcttttcctctttgtttttgtctttatctttttcgataaaaataattggaggcttttctttcgtccccgctttcttttcagggtacggataatttttcagaacttcgttcatactttccaaaacggagtccaagccatcagttatcatttcttgtaatttcaagtatgctgaatcactaatctttttagatttcttctttcccataattaagcaatattacgcaaaagtaaattaaatctttgagaatcggtaaaattccgagtattaaatcggaatgtaaattcatcaacgtacttttgcaaatgttttctgcttacccgaatataagttcctaacatcatcctatcaaagtgcgaccatacattttcgataccgtttgtactgacaacgataatctcaccttcatctgtaacataagtcgtgccatagaaatgtttactatgatctacatctctttgttcgtaatcaatattaatgcccggatagcctgctccgtctgtataaacaacactccctttttcaacatgttcgtttacaatagaaagcaatgtatctccatgaatgttgggaactactttagcaactaccttcccgcctctttcaagcattccgaatacaggaactttatccttataactacgtccttgacatttctccactttcttatctttatgcctgtttttgttttttcctcctataaacgtttcatctatctcaacttcaccggataacttaggattatttgcgtttgattttgcaacaagttctctaattttcataagcatataccacgctgttttttgagtgatctctaacttacgagctaattgacatgaggaaataccacctttatctgcttggaataagaatattgcaagcaaccattttgtcattggcaatttggtgtttgcaagcggagtacctgttttaacatcgaaatagcgtccagtactcttacacttgtatttcccattaccacatttgtacaccttagatgttggatcaaatggtgatattacattaccatcccatctcattttctcaaagtaactgatagctttttcctcacttgaaagagcctttgagaatactgtgtataaactttcgcctttcataatgtcacatttttaactacctaaatatactaaaaaccaatgatatatgcaagcaatatgccacatattttccaaaaataagtctgtaaggatgctaaaaaacatccttacagaacatacagaaccattaccgtttataaactataaacagtaattttgcaagaatactaacttaaaaaatggaagatatgatacctattgcatcatctgcgtttctcggagtagattataattccgaaacaagaactttaacagtttattttagaaatggaagaaattatgttcatcatggagtgcccgaatcagtgtacaaacaatttcttaactctccttcaaagggcaggtattacaatcagtacataaaagggatttatcaataggcattaattgccatgcattttttctaatccaatcaatatctacttcatgcggatcacgatcaatacaaaagcatccgcatgaagtatcgtagtattctctcaattgttcatacgtaagtttgctagttgaattctttttcccttcttcaattttcttttccataatctttaatttttaaatattaataaaaagccgtatttctacgagctataactttttcttataatgataacgctaggtgtcagctagtatataactgcctaaataaaacattgtaataatgatcagaaaatatttgtattttatactttcagttttcgcaatatgaagatgatatgtatgttcagttgactttcatggaaacgatggataaatacgggatggatgctccggccaaaaaatatcaggagttattggctaaagctaactataagctatggcatgctaatgtgcaggctcgtaaaaacttccatgatagtatatttccaccgcaatcaggacatcccgactacaatcttcatgcggatgatattgactttcagattgaggctgattatataggttttatgtgtccggggatgccgcaaacggccaataaaatggctgataaaatagggcatattatgaactgattcagattgtaatccttcaaatgcagttgcccttttaggagttatgaagggatttagtggtttgccggttgattatcagaaggcagtgaaacaaatgggagattcattatttctacatactagttattcttttcattctgccgtaaaaagaacaatggaatatgctcaggatataatcattcagaatgaaggaaaagtgatggagaaagaagtaatgattgtgcggcagcaacctgtagcttttccgatggaagatgcttttcaaggagtggcttttcataaaagattgaatatgagtgatccgggatggaatttgagcggttcgtggatgatggataaggataagtccgctatatttagcaataaagcgggggatgaacttagtctgaattttgaagggacgggagtatctattgaagggtggtggataaaagaaggtggtaaagccgacgtatatattgacggagtattgaaaggcaccattgattgtttcttttattatgcgaatcaagagcatcgggggattaatattttccatattttgaatttgccgcaaggcaagcattctgtaagattagtcgtaaagggagaaaaaagggcagaatcagcagactgtgtgataggagtgactggagccgttatttttagggcaagcggggaactctagagaataatatttattgaaatccagtatgggataagctattgtttcccatactggtttattggtagtctctctatatagaaccggacaattccttcacacttagttagaagaaatattcattggttagaaagaatattgtaccagcatattcaaccggttagcatgacgggttgaagaactgaaatcagtacgccatcctctcaaatactcaacgccgacttgcaggttactgcttacattccaaaaagcattggctaccagatattgtcctttgcgataggattccggattttcacttggatatccgttttcagaataaagtctggataaactatatgtaccggatataaagatgctcggacaaaggttgtattgcagccctgcataccatcccagcattgggagaacctgcatttttccctcattatcaggatcgggaacgatatctacgttcagattacttaaatcgttcaggtaagatccgataccttttccataattaaactgtccgaatgcctgtaatttcttcgtaatattgaaggttgtagaggcttgcagaccgaatccggtggcggaataggctttctcatgaacgttacttgagtaagtcatactacggagaatagcacctaatttaacgtgactgctactattccagttatactgtacggaagtggcaaagtccggcattcgttgggtgttgatagacaagtcattgttggttgtaccgtctactgaaggcatttccatcgaaacaccaaatttccagtttttcaacttatcgcacatatagctcaattgcgtagtgcggtaaaaggctgatccgttaggacctgcaaagtcgatggtaggaggcagtgcggagaggtccatgaacgaaccgtagctgtatccgatcgtgaaaccgaggaattgcgcataagcattctgcaattcaaaggtttttccgtcaccccggaagtttccggctgtgtatacaacgaagtctcccagatgtttcgtacgtcctaccagtttgaggaatagggtagaagtggtgatgtccatctggaattgatttttggcaaaattgccgcttccgcgttgtggaatcaatgccggatagaaatcgacatcatttacgataccgttaaagtcatactctgctgttgcacgaacatatcctccgatgcccagggcgaatttccctttctggtcggtgagcaggaagcggggagcattcgggtcgtgaaaacgcatctgtgaacggtcgttcatgattcggataatttcatctcctgctttgttcttcgagacaaacatgatcgagttgggttcttcatcttcgatgattacctttttttgtgcatgggcacagagggggaaaattcctatccccagtagcatagctaccattttaaagcttgttttcattatgagttaagttttaggtgaatgcccaatgaacaactaaaaaaagaaatggttgagaggggcaagggaaaaattgccaaactaatcggaagaattgctatttataatgattctaaaaagacggatctttgtaccgtactaattagataatagagatacgacgatgggaaaagtagaatttactcaaggaatattagacatacagccggatttgcaccgttttgcgtataagttgacggcagaccgtgattctgccaacgatttggttcaggactgtgtgttgcaagcattggacaatcatgagaagtttacgtatagtaagaatctgaaaggatggatgtatacgcttatgcgtaacattttcgtcaataactaccgtcgtacagttcgtgaaatgaatctgattgatgacagttattctatcaatcagcaacatttgatcgaagatgaagatgccgacagatttgaatttacctatgatatgaaacagctgtatcgggtgatacattccataccggaagaaatgaaagttcccttccagatgtttgttgccggatttaagtatagagagattgccgagaaattaggattgccgatgggaacggtaaagagccgtttgtttttcatccgcaagcggttgaaagaggaattgaaagatttctcctcctgatgcagatgcctgattgagtgatgtgttttaaggtcaaagtgatgagcctacctgtcagaatacgacgctgatgggaaggcttttcttatcttttattttgagggaacatagattctgataagatgaatgtgacaattccagttttattttctacctttgcaccctgaaagaataaaaaatgtatgatgccgtgaatagcggtcgtgtattctagaacaccacgtaaaaaacaggaattatgaaagaaaaagtatctgtaccctttatgctgctgggcattctgtttaatgtctgtctcattgcagccaatctccttgaaacaaaagtaatccaggtaggtagtctgaccgtgacagccggattattggtttttcctatttcttatattattaatgactgcatcgccgaagtttggggattcaagaaagcgcggctcatcatttggagcggttttgccatgaacttcttcgtggttgctcttgggttgatagctgttgccattccggctgctcctttctgggagggcgaggaacatttcaattttgtgttcggtatggctccccgtattgtggctgccagtctgatggcttttctggtaggttcatttctcaatgcgtatgtgatgagtaagatgaaagtagccagtcaggggcgtaacttttcggctcgtgccatctggtcgactgttgtaggtgagactgccgattcattgattttcttcccggtagcttttggtggagttattgcctggaaagaactgcttatcatgatggggattcagattgtgctgaaatccatgtatgaagttattatccttccggtgacaattcgtgtggtgaaagcaatcaagaagatagacggtagcgatgtgtatgataccgatatctcctataatgtattgaaagtcaaagatatttaagatagaatatgaatagagaagcagcattggttgtgtttagtggtggacaggactctactacttgtttgttttgggcaaaacgcaactttaagaaagtatatgccttgagttttctttacggtcagaaacatcagaaagaagtggagcttgcacgggagatagcccggaaagcggaagtggaatttgatgtgatggatgtttcctttatcggacagttaggtcataattcattgaccgatactacgatggtgatggatcaggaaaaacctgcagatagcgttcctaatacctttgttccgggacgtaatctgttttttctaagtatcgcagcagtatatgcccgtgaacgtggtgttaatcatttggtaacgggagtttctcaaacagatttcagcggttatcccgattgccgtgatgcctttatcaaatctcttaatgtaactctcaatctggctatggatgaacaatttgtgattcatacccctttgatgtggattgataaggcagaaacatgggcattggccgacgaactgggggtattggaactgattcgcaccgagactttaacctgttataatggcgttcagggagatggttgcggacattgcccggcttgtacattgcgtcgggaaggattggaaaagtatttaaaaagtaagaatcaataatatctctacatagagattaaaatgcgtttttttgctgtcatctgtcacattgttgtagataaatgtttgattataagatttctagtttgtgacagcaagtagtgacagcagctaaatttgacattttgccgtcacatctattgtcaccggtaagttctaattaataaatgatagtagtttctgtccggaatgtattggcttagattagtttcaacagcttgaaactgttgtttcatcagtgagaaactaaagtttcaacggtaggaaactaaagtttctaacgcttgaaactataagttccaagacttgaaacagtttgttccaagtaatgaaacactttgtttcaaggcgggaaacacattgtttcaggcaatgaaacacaccgtaacaagtaagatgaggagaaagcaaacgtaggataagagttgatggtgataggtgatagatgcggtgataggttgtgaaatgaatccttcaccactaaaacctcgatgaataaggcgtttgaggcaggacggtgataggtgaaagaagaaatgcgtttttttgtttagagtagaggttgtagttaatgagtgcaatgacagaattaaaagaccaactttccttattaggaagaaaaaccgagtataaacaagattatgctcctgaagtactggaagcctttgataataagcatcctgaaaatgattactgggtacgtttcaactgcccggagttcacaagtctgtgtcctattaccggacagccggactttgccgaaatacgtatcagctacattcctgatataaaaatggtagaaagtaagagtttgaaactctatcttttcagtttccgcagtcatggagcctttcatgaagattgtgtgaatatcataatgaaagatcttatccgattgatgagtcccaaatacatagaagtaacgggaatatttactcctcgtggtggtatttccatttatccgtatgccaattatggtcgtccgggaacaaagttcgaacagatggcagaacatcgtttgatgaatcgggaataatataaataaaagaattcactagctaaaaagatcgaatatgactcatcatgtgcctgctgaattacaaaactatgttcggcaaagtattattcctcaatacgctaactttgataaagcacatcaaattgaccatgtagaaaaggtaattgaggaaagtctgaaattagcgacgcattatgaagtcgattattcgatggtttatgtcatcgctgcttatcatgacctggggttgtatgaaggacgtgaatttcatcatataacctccggcaaagtgttgctagccgacgaaactttgcggcgttggtttacggatgagcagctgttgcagatgaaagaggcgatagaagatcatcgggcttccaataaacaggctcccagaacaatctatggaatgattgttgccgaggctgaccgaattattgatcccgaagtcactttacgccgtaccgtacaatacgggctgtctcattatccggagatggataaagaagagcaatatgcccgttttcggaaacatctaactgaaaaatatgcagaaggagggtatctgaagttatggataccccaatcggataatgccggacggttggcagaacttcggaatttgattactaatgagggggaactgattaaggtatttgataagttatattctgatgaattaggatagactatcctgataattttatacttctataatttaccggattgtggctactttatctaatataaattgcttcatatcgtcccattgaatattagaaaacattttgggcatgagttcgtcttctgcatcttcaaaataggataggctcatcagtccacgaaagacagaattctccggatatttctcggcgtaaaacttcaatatgtcatctaaagtgtaatgttgtaataggaaatacatatctatgaaatctttttttgttcctctaccttctatcgcgttaattttcattgcggcaatatctttgggagaagctaaacgcaatccgtcttttttaataacagaatctatccatggatatttgtaattaacaaaatcaactttgataccattgacagaatagatttttatgttggttgtttctttataaacagatatcggaccaatagagcgtaatatatctctaattgctatactatcctcttctatatccccaaagaaattcagatctatcgacatacgatgtccatattgaagtgcaagggctgtgcctccaactaatcttgcctttgctaaaaataattccggagttagcttttttagcaattccagagtgtggggttcgatagtcttgtatgataacatcgatattcttcttttgaggtgtttgatatacaacagacgtatgctagagcttttgggtctaatgtacgtaatgatttacatattgatacaattctatctaatccgtaataagaacatattaaatgccaatcttttaaagtgccatattctaaaacacgttggataatttgtgctgggcaagtatccatatctgctttggatatatctatatcccaaaacaaatggggagataattttgatatatattctttttgttccatgaattgcaactataagattttctcttttttacaaagaaactattttatttcagattagccaaacaggcaactccttttaacatcctattgggaatactttattcatgatgatacggccctccattcaatatagtcatcgcccgataaatctgctcaacgaatatcagccggatcatctgatgtgagaaagtcatcttcgacattgaaatcttttcgtgtgccgcttgataaaccttttctgaaaagccataaggccctccgataacgaataccagtcgtttgttgaccgtgttcatttttcgcttcatatattcggcaaactccagagaacgcatttcttttccgtgctcatcgagcaataccaccacgtcgcccggttggagagctttcaatatcagttccccttccttttctttctgcacttccattgaaagactcttcgtgtttttcaattcaggaatcacttccatgtcaaaagtgatagaccgtttagtgcgctggatatagtcgttgatagcagttatatagtgttgttctacggttcgtcctacgacgagcaaggttgttttcatacgtctacaattctgattattgcacaaaaataggcattttttatgttattctgcaattaatgcttacctttgcctatcattagttgaaagtttaagcctttaaacttcaacttaaaagcttgtaattatgaaaaaacgagtgctcgtaggaatgaccgcattgcttctttccctctcgttgctaatggcgcaagagataccggcaggagtgattacggcatttaaaagaggaagctcgcaagagctaagtaagtatatgggggacaaggtaaacctggtgctccaaggtcgctcgacaaacgttgacaaacagaaagcaacagctgcgatgcaggaattctttacgaagaataaagtcagcggatttaatgtgaaccatcagggaaaacgggacgaatcgagtttcgttatcggtacgttggctactactaatgggaactttcgtgtgaactgcttcctgaagaaagtgcagaatcaatatttaatacatcaaataagaattgacaagatcaatgaataaggaaaaagaactgatcgacaagttgatcgatcttgcttttgcagaagatataggtgatggcgatcataccaccctttcatgtattcccgctacggcaatgggaaaatcaaaattgcttatcaaagaagccggtgtgttggctggcatcgaagtagctaaagaaatcttcaaccgttttgatcctaccatgaaagtggaagtgtttattaatgacggaacagaagtgaaaccgggtgatgtagcaatggtagtggaaggaaaagtgcaatctttacttcaaaccgaacgcctgatgttgaacgtgatgcagcgtatgagcggtattgcaacaatgacgcgtaaatatgcaaaggtattggaaggaacaaatacccgtgtgcttgatacccgcaaaacaactcccggtatgcgtatcctcgaaaaaatggcagtgaaaatcggtggcggagtaaaccatcgtattggtctgttcgacatgattcttctgaaagacaatcatgtggactttgccggaggtatcgacaaagcaatcactcgtgccaaagaatattgcaaggaaaaaggtaaagacctgaaaatagaaatagaagtccgcagcttcgacgaactgcagcaagttcttgatctcggcggagtagaccgtatcatgtttgataacttcactcccgaaatgacaaagaaagcagtagagatggtagcaggcaaatacgaaaccgaatcttcgggtggtatcacctttgatactcttcgtgagtatgccgaatgtggcgtagacttcatctctgtaggagctttgactcattcagtgaaaggactggacatgagtttcaaagcatgctgatagtataataagcggtgaactgtaagcggtgaacgataaacagtaaacggtggatattttgtagcatgattatgcgcagctttgttcatcatttaccgtttatcgttcaccgttttttctttcccgtttattatttctatcctttaacttcttttagcaatattccttgcagcattcctcaaactctcgcgtctaatgagcaaacgacgcagacatacgttcgattttaaaaaaagtaattgactttggaaaacgagatagaacttataaagggctgtcgggcaggaaaggattcagcccgaaaggaactttacactctctattccaagcagatgctggcggtatgtttccgctatacgggcgatatggatgcggcgcacgatgtactgcatgacggtttcatcaagatttttaccaacttttcgttccggggtgagtcttcactttgtacatggattacccgggtgatggttactcaatcactcgatttcctgcgacgggagaagcgagtcagccagttggtagtgcatgaagagcagcttcccgatataccggatatatcggattcgggaggaggggctggaatttccgaagagcagttgatggcttttattgccgaattgccggatggttgccgaaccgttttcaacctttatgtgtttgaagagaaatcgcacaaggagatagccaagatgcttcatattaaagagcattcatctacttcgcagctgcaccgggccaaatatttgttagcaaaaagaattaaagagtatagaaatcatgaagaaagaaaatgatgaaataaccgatctgtttcgcacgcgtctcgctgatgccgggatgagtgtacgggatggcttttgggaagagctctcgcaggaaattcctgtggcttgccagcatcgtcgtcggattctgctcttccgtgtagcggctgcggcatctgtattgcttgttttggcagcctcgtcggctactttcttgtatttctctccaaaggaggaaatggaagaagcatttacaaagatagccgtgacgaatggaggacagatggatggagatggaatacgcgtcaatcagttgccgttgccggtagaaccggtgttgccgaaaccggctccgaaatcttacggtatgctgtcgcaatatacggaggaagaagattctctttcaatcactttctctatgtcgttttctttttcttccactacttctacgggaaatggcaaccgatatggtaatcaggggcataatggttattggcaggcaacaaacggtaatacaggatcatctgtcgcttcggaagaacagtcgaatgtcgatatgtctcaacccaaagcagtgaaaaagcatcgctgggcgatgaaagttcaagtgggtacagcacttccggcagataacggtacttataaaatgccggtttccgcaggggtgacggtagagcgtaagttgaacgattttcttggcatagaaaccggattgctctattcgaacctccgttctgcagggcagcacttgcactatctgggaatccccgttaaagtgaacgtgacgttggtagatacgaaaaaaatcgacctttacgctactgtaggaggaatagccgataaatgtattgccggtgcaccggacaacagttttaaagaagaacctatccagctggcagtgactgccggtattggaatcaactataagattaatgaccgacttgctgtttttgccgaacccggagtttcgcatcattttaagacagattcgaaattggctacggtacgaacaaaacggccgactaattttaatttactttgcggactccgcatgacgtattaatccttatgaaaatgaaaaaaacactactaatgctgtggatggctgtttgcctgatcgtatcctttacaggatgcaccagcgaagaaatggattataacaatccggatgttgctctttttgtgaagcaattgaagtcgggtacgtacaagatgaagaatgaaaaaggggtggtggaggttcctcatttcacggaagaggatatccccgaacttttaaaatatgcagaagatctgactattatcccttcttttccgtcggtttataatatgaacaacggtaagattcggttgggtgagtgtatgctttgggtgattgaatctatccgtcagggcacacctccgtcattaggttgcaaaatggtattggcgaatgctgaaaattatgaagcaatctatttcctgaccgatgaggaagtactcgatgcagccgcttgttatcgtagttggtgggaagaacgccaatatccgaaaacgagatggacaattgatccgtgttacgatgagccgctttgtggatcgggttatcgttggtggtaataaagggggaggagccttcggaaagtaaaaaataggaaacattcatgtgggaatatttgtttgtatcagtagtcttttgctgctgacagggggattattacgctcaaaagatagcctcttatacgtacaaatgtatatgaagtgctccgaaatataggtaatgaaagagtaaaaagaatggatggattaaaacgggttataacaacgatggcactgtgcctgaccgctgtatttgcatattcgcaagtatggacggcgcaagattctttgcatttgaagaaattgctggagagtgaccaggagttgcatttaaatatggatgctgtgaagtcgattgatttcggaagcgcagtgggtactccccggatgtcggaggagaaaagctggatgatgcctgacgaatcgcttcctgaagcgttgcctaaaccgaaagtgatgttgactctgatgccatataaagcgaatacccgctataactgggatcccatctatcagaagaagataaagatcgataaaaatacctggcggggtgatcctttctacgagatacgccatcaaagatcttattcaaactgggcacgcaatccgatggcaaagggaatgcgtaagtcgttggatgagatacaggcgagtggggtacgtttccgtcagttgggtgaacgtgctaacggaatgatggtgaacacggtagtgatggatgcacctattcccttgtttggtgggagtggagtgtatatcaatggtggaactatcggcggacttgacctgatggctgtctttacaaaagatttctggaataagacgggacgggataaccgtgcccgcacattggaagtgttgagaacttatggagattctaccactgtgttgataaataaaccaattgaacagattgcccgttgaaggcgttataatgatgtgttgatgtagcaatgcgctaatgtgctgactagagaatgtttgtaattgaataattagtatatttgtgtgttgttatgttggcgcattgttatatagctttgtcgctattattggtatcttagtatattaacacatagataaattattggttatgaatagaattacttctcttctgggtattcggtatcctattattcaaggtggtatggtgtggtgcagcggttggcgtcttgcttctgctgtgagcaatgccggtggactgggattgatcggtgccggttccatgcatccggacactttacgcgagcatatccgtaaatgtaatgcggccacgaaattgccttttggtgtaaacattcctttgatgtatccccagatagaagagattatgaatattgtggtggaagagggagtgaagattgtttttacctctgccggaaatccgaaaacgtggactgggtggttgaaagagcgtggaataacggttgttcatgttgtttcttcttcccgttttgctgtaaaatgtgaggaggctggagtagatgcggtagtggcagaagggttcgaagccggagggcataatggacgcgaagaaacaacgactttctgtttgattcccgctgtacgtgaggctacaacattacctttgatagccgcaggaggtgtcggtacaggagaaggaatactggctgctatggtgttgggagccgaaggtgtacagataggaacccgttttgctcttactgaagagagttcagcgagtccggtatttaaagattattgcttgagtctcggtgaaggggatactaagttgttgttgaaaaagctggctccgacacgtttggtaaagaatgctttccgcgaagcggtggagaaggctgaagatagtggtgctagtgcagaagatttgagaactttattaggacgggggcgtgctaaaaaaggaatcttcgaaggtgatctggaagaaggggaattggagatcggacaagtttcggcaatcatatcccgtcggcagtctgtggcagaagtaatggacgaattggtagcggcttatcaacgggcagcaaagaaagattatttattttaaagatatagctcaccacagagtaatacaaagtcttgcagagtttttttaaaagatcatcaatcgaaggcgtaagacattgagatggccttattttgaaaaagaaaaaactctgtaagactttgtgttactgtatggtgaaaatgcatagttataggctgataggatcgtactttaaaccaaatacgtcggctacggccttataaacgatttttccttctacgatatttaatccgagtgctaatgctggattctctttgcaggcttttttccatcccttatttgctaaagcgatcacataggggagggtagcattggtcagtgcaagggtggaagtgtaaggtacagctcccggaatattagctactgcataatgcacgattccatctacaatataggtcggtgcactgtgagtggtcgggtgagaggtctcgaaacatcctccctgatcgattgctacatctactaatactgtgccgggctgcattattgaaagcatttctttggtaatcaaatgtggtgctttatcaccgggaatcagtacagagccgacaactaaatcaacatccggcaattcttttctgattcttagttcggatgcgtacaatgtctttacattcttcggcagtgtctcgctcaaatagcgcagacgtgccagatttatatctgtaatagtgacatctgcccccattccagcagccatttgtgcagcattgctacctacaactccacctcctaaaattaatactttagctggtttaacacctggtacacctcccaaaaggataccttttccgccttgcggtttttccagaaaacgggcgccttcctgaatagacatacgtccggcaacttcgctcatcggaattaataaaggtaatgtatggtctgcttcttctacagtttcgtaagccaggcatattgatttgttggagagcatggcaagggttaactccctgtcggaagcaaaatggaaataagtgaatagtaactgtccttttcttattaagttatattcagtgattatcggctctttcacctttacgatcatctcggcagtagcgtaaatatcttctattgttggcaggatatgtgcgccgacagctcgatatgcttcatccggaaaaccgctatttattcccgctgtatgttggataaatacccgatgcccttgttttaccacttcagccactcctgaaggtgtcatgcctacacggttctcattgtttttgatttcctttggtactccgataatcataatgttgcgtattaaagatttaacatgttcgaaagtacgaaaaatccccttacgttgttgttcgtaaggggatgttttagaacagaatgtcttcgcgtgttgagatgaataaatgcgtagagtggttgttttatagacattcactgccctgcttgttgattttcatgctttttccatagagacccactcgagctatgttgttataaaagggttctgcaatatcgtacttaaaaggaagtacttcttcattatctttgtttatgtatccccacttggatgactggctttcaatgcaaacagcagccaatccttcggaaaaagagcatccgttatcatattccagcggaatgacaacttctcctttcttattaatgaatcctactttgttgtgtagtgagacgagggctaatccttccgcgaattgctccatttgactgtaagtcggtggaagaatgtagtttccttgtctgtcaatcagtccccataatccatcgtgacatactcgtgcacattcttgctcaaacgagtgagcggctgcgtatttaaacggaatccgtatttgtccggtatggtcgatgaatccgtattgagaattgagtactaccatccctaatccttctttaaacgagaaagcccgttcatacattagaggaatgacaacgtcatattctttattaatgtatccccattggatttttcctttaaccggtgccaatccttcagagaaacggccaatggccgagaagcgctttttcttattagctaccccataagctaaaaaagaagcgaagaactttgtaatagtgctgctcattacctttattgtttgtgtggtaagcgtccggataccatatatatacaagagaagcgtggacgtcgttagttcattctattcaaggctctggtaaacctattgggaaatgaacaacagagtccacgcccttgcatataacaaagacgtgaacgcttagttgccattatctccccaattaaagaatttaccagattctgaatagagataatattctaaacgcttctacgttattaatcgtaataagtcgctacaaagatacggatttcttgttaaagaacaatgcttttaggggataaagatttaatggtgaatgaggtaggtgtacaaaatgagaaatggctagtagatagattaaaaaaagctccttttacgctttaggtaaagggagctttttagtctatgatgtcaggcggtttgtttctatgaaaaatgcttggttattagtttaaaagtccgggattagcatcaattgcatcttgtggaatacgcaatgtgtaacgggaatcatcttgtacaagtgtgtaggttacatcttcaatttcttttttgatttccggtcgggtagttcggcgtaaatcaaaccagcgatggccttcaaaagcaagctcgcgagcacgttctttcagaatttctgtgactagcttttcttggctcatcgcatttatttcattctttttctgctcataaccttctgatgtataacgattctctattagtttcaagagccgggtacgtgcttcaggtaatttgtttaaatgtgcagcagcttctgctgaatttaaataaagctctccggtgcggaaagtacatttgaatttagattcaccacttttgatggaagtataatttccatttttatttgcttgataatacttgtttggacgtagatcttttccttcctcatattcttgtaaaaatgaagggtaaagtaagagtgatccggcataatcgctatttggaaaaacttcataggcagtgatcatttctacagatgtaaattcattaggaagtttgcctccttcatcatttaggtttaccaatgtcgattttccggctaatatacgttccgaagcttcataagatttgctccattcacccatgtataaatatacccgtgattccatagcatctactgataatgttgaaaaacggtatgaatattgaatttcccattcttttttattaatcagtttccgtgctgtttctatatcagataaaatagaggtatatatttcctttacagtatttcttgatggtatttcttctaaatcagtattgagttttagaggaactgctttggtttctaatgctccggtagctgtataaggttgtccataaagattgaccaatatgaaatgcatatatgctctcatgaggtaagcttctccaactaattgattaatatcttcttggcttccttctgatatttcatcttttttatcgatgattgcgttggcataatagatattggtataataggccgcccatccaaattgtctcgtacttgcattcggattaacatcattccatttttcaacatctcctaaagaatttttggaagtggcatcagactgtaatatggttgcgatatctgttctgatttcgcatattcctctgtcattgagtgctgtattgtaagctgttgtgaataaagctctgtattcagctagcgtattgggaattacttggcctactggttgtatgtccaaataactatcacaggaagataataacaggcttcctattaatgtgaatatataatatattttctttgtcataatatattttttaaaagttaagacttagattgaaggtaatggatttgggaactggggtagagtataggttgcccattgattccggatccatataattatcataattagagctgataacgaataggttacgagcctctaatcctacagttgctccgccgatacttagtttatgaagccattcggatggaacccggtaagcaagacgtatattttgtagacgtacaaagcttagcttttttacccagatatccagtgatctgtaaatgtcatttcgagtactgaacaagtagtagtcggccggattgtaattgtacgttgctaatgcagggaactttcctgttgtattttccggtgtccatctatccagtatgtctctattcatattgcgccctgggtctaagtcagatacattataacttggagttgtttttacgtgtgctccaaaattatatgaaaaattcagattcagttcccaatttcggtaattgaacgtatttagaaaaccgcccgtgtagggagcatctgacgttccaacatagctgtaaaagtctctttgttcttcagtacttggtcctatttggtaagtgccaagaccatcttcattcgatgtcattctgaataactcttctacagtgacagctttcccctctttattctcaagatagatttgtcctgtatcaggatttataccttttgtttttagtgcaaagattgcacctacgggatatccttccagactaggagtcacttggcttttatctgtaagtacttttagtactttattttgattatatgcgaagttgaaagtagtgtaccaagagaagtttttagtggtgatattacgtgtctgcaggtttatttctacacctttattttccatactagcccagtttatagacatattagtgaatccattttccaaagctaatgctttagaaccaattaagtctgttccttttctatagtagtaatctacactaagattgatggcttgattgagtacagaaaaatctattcctagattgtaagatgctgttttttcccagcgtaatttactgttgggagcactattgataataatattttcttcactgtaaccaggtaaaatattcacattatcatattttccgactaggaatggagaggttcccttatcaatatttccttgtaagccataagaaaggcgaagagctaaattatcaacccatttgtattgtctaatgaacgactcatttgataaacgccatagaccacttaccgaatagattggtaagaaacggtatttcttatctactccgaataaatcagaaccatccatgcgcacacttcctcccaatgtataacgattcattaaagtatatgaaccattggcaaagaaagaagcaaaagcgttttccttgtacgatttagtttttagattccaatcattggcttgtgcttcatctttaaatatgagattctggaatgtcagtttctttggatcatacccatatccggttgaggcttggttgtctgcccagtttttgcgaatttccgaaccagccattatttgtatatcatgtatatccccaaatgtgtttttgtattctccctggattttccatgtgagttgtgaggttgtgctattagttgttttaagcatacctccttctggtataagataggtttgtacaccatctttccaatatttattgttttcacgtatattcctaatattatatgaatttatcccggcatattcttcttgcgacaattgatcccattgcacaccaatctgtgaataaactttccactgatcgttaaaacgtagctgaacatcaaagatagaattgatggctgtggtgacagattctttattggtgtttgctcgttcttcgaatatattaaagccttgcttttcatctgtttcattacttctgactacgtcgtaatcgtaaaggtagtttccttgttcgtcaaacggagcaaagtaagggttggcgatacgtgaataatatatagggttaataagtccgtaagtatcagtcataaatgtgttattcttgcgtctgttggcaaaaatagacattccaatttttaatattttgttgatttggtaagacgttttactggtcagattaaaacggctcatgcttacacctggtacatttccgttttctttgacataaccaagtgagttgtaataagtaaccttttcgctaccaccggaaatgctaaagttatattcttgcgtgaaagcatctctgaataatatatcattccagtctgtattgattgttttcagtttgtttatagcattttgggcttcaggtgtcagtccgttccacccctgttctttatagatgtctattaagttatattgtttcatgatagcagcaacttttcctttttcaggaaataccggtatcggatctgttaatccccataatatgtcaaaccgtgcttcttttaataattgaagttccaaatcgactttctcttccgagtttagtaagttgagtcgtgaagtattgagatttggagtataagtcaatttagtattgaagttaataacaggttttccggtttttcctcttttggttgttaccacaattacgccatttgcagcacgtgcaccatagatagcagtagcagctgcatcttttaatatcgtaatgctttcaatgtcgtttggacttaaacctgcgatagaagattgtgacatatttacgatgtcattatcgttgtctttgttgatttctggaatgtccgtaccctccaaaggtatcccatccaatacccacaatgggtcttgtgttccatttaatgaagccgtaccacgaatacgaatacgtgctggagctcccggtgcaccagaagttgtcgtaacagctacaccggcgatttgtcctgctaacgcctgatcgatactttttgcagcacctaccattccatctgtaacatctactttggcaatggcagcagtcagtttacgacgttccagttcttgataaccagttactactacgtctcctaatgtgtgtgatgaagcttgaagtacaatacgataagtatcttttcctgtttgtaatatgatgttttgttcttcaaaacctatataactacaatgtagtctggtcaccttttccggaatggaaatggagaatttaccatccatatcagtgatagtacctagagaagtctgtgatactccggcttttttcaaatcgtctgcattaacatatacagaagcaccgattagaggttcattgtcttcaccggatatgacgactccggtgattgtgcgattagcagcgttggctgtagccaacgtgctaacaagaaaacatataagaacgtataaatatttttttctcatcaatatagattgttaaagtgattgattttgttttatttgattcccaaagccgtattaatacgtagaatcatatcctcataatgatagcgtgcagcagtatcagaagtgccgagacggctctgcaacaatttcttgatacgtaatagctctccgcgtttcaccgagatagcatcagaaatacggttgagctgactaccatagaagttaagcacacgtggagcgcccattcggtcttcttggcgaagtgcccgttgttcggctgcataacagctgcagaaagaagtggcatggtcaagcaggaaatgctcatttgcaatcttcttgttgatttttacagcttcgggttctgcggctgctgtaagtaatgcatcgaggaagtttttctgcaaagaacgttccattacgttggggatgccaccacgttcggtaataccgaaaatgtttttatgaagtccgtccataagctccactactgtgaaggcttttttcccgttgacagactcattctctatcatacgcatcaaacgggtgttgcctagtaaatcccaaaggatataggcttgggcgttctttaagatttgcgtaggagcattctcctgttttccgatgggagtattacgaagtagataagtatattgtcctacttccgtgtcaaacagccatttaggatatgttaatacttcatccatcagaaattttagtgaagcttgttgtttctctttctcaacgaatgtataagtcttgacgccatctccaacaattgtattttcaatgtagataccgccaatattggcaaggacatgatataaatagttgttccattggttgattactgcatagtagaggcgtgatgcttcttcataagtttgtcctttctcgccggtagtagtccattgaagaatttgcggaacaatacgtttcagattctcaatgccaagtaaagaagaacgaaccggatcatcacctaaatcttcgttctgtgcacgtggatctaccgcatcacgtacatcctgtgcttcactatatttataaagacgatcagtatgtttgctcaaaaaatcgaataaaacatccttttcttcttccggagtcttctttccgtaccaacgataaccatattcgatagcaaacatgtcataaggaccgatatgcggagaaagaactttcacgccatctcctggttgtgcgatataattgaatcgtgcataatccatgatagatgaagcggtagaattcattctggaagtgaatgcttcggaacgtaatgaatccgtcgggaaagcccatgatcccatcatattgtgacggagtcccaatgagtggcctacctcatgacaggcgacgaatcgaatggcatctcccatcaaagcatcaggcaattgtacattgcgtgcttccggacacacagttccggtctggacagtaatccattcacgtaccatagaaagcacattgtgccaccacataatatcagcttccaggatttctccggaacggggatctaacagagaaggtcccattgcatttttcttttccgaagcagcataagtcagtacggagtaattgacatcatccatgtctacatgcatactgtccgtgatttctttggcgataatcgcattcttgaaaccagccttttcaaaggcaatctgccagtcctcgatacctttcttaatgtacgaacgccattggtaaggagttgaattgtcaatgtagaagataataggtttggcaggttctaccatctgacctttcagataagcctcccgatcttccggtttgggttccatacgccagcgggtgatatactgtgtcttatccgtacgctgctgcgcatcactaaaacttaataacggattcgtgaaataaccgaccttctgattgtcgaatcgtcccatcatcggcttctcgggtaataagagaatagaagaactaacttccaccgttacataaacagtagtagtaccttccgttacccgggtagtcaactcggaagttgccacgacattgtttgaaaaggatttgatggatagaatacgtgataaattcttgatagccgaagtacccagattaatattggtaaatacgttattgatactggtttccgtaccatcataaatatcattcaccttgattactaatgccgtagaatctgcattgactgcttcgatcttgaatgcggcaatcagcggagagataaaattatcctttaccgaacggaagatagcgtccgtttggggggccagaggtaatggacgttgttggcgtaacattagtttgcccgtcgctttgtcccattccatgcaaaccatctggttttcatagtttactccgcggtttacacccgcatcattaagttcggtaggaactcgttgcagcttattgacaactaataagtcacgtcccaaaagtgaggtgggaatttcaaaataataatcattcttcttttgatgtacagcaaacatccctttggtcgttttactgtcttccactaatttctcgtagtcgcttttactcttctcttctttctcttctggttttttctttttctttttaaaccaactcagattttctgtagcgggggtagttgcaaatgccgagagcgcttctccactcagcaatatacatgcaatgaccgctgccattacttttacatacattctcattgagtttctaacttttaattataattaaaaaacggctacaaaagtactaatataaataacataatgactactaatttgcaatgaatataacattaaaaagaaatattaactagtatctacggtcatcattctcctcggatatttcatagtttagtgggaatagtgtacatttgcgggagtaaaaaagtgaacggaatgatgagacgatatatcactgctttgatgctggcttgctgcatcggagggtatggacaagagaagaagcaagtaacctttgtacctccttttgactttcctcttacattgagtgggaactttggagaaatccgctccaatcacttccacggcggactggattttaagacaggcggagttatcggtaaacccgttcgtgctctcgctgatggctatatttcgcgtattcgcgtcacgaatggttcgggatatgtacttgatgtctgttatcacaatggctattcaacgatcaaccgccatttgagtggttttgtttctcccattgccgaaagggtggagaaacttcaatatgaagaagaaagctgggaagtagagattgttcccgaaccgggagaatatccggtaaaaggaggccagcagatcgcatggagcggaaacaccggatattcgttcggtccgcatcttcacctggatgtatttgaaacggaatcgggagattatattgaccctatgcctttctttcaatcgaaaataaaagatacgcgtgctccgaaagcggatggcattctattttttccacaactgggtaaaggagtagtggatggaaagcaagagaataaaatcatccttcctaatagtgagcgtccggtggaagcatggggagtgataggtgtggggatcaaagcatacgattacatggatggagtgaataaccattatggagtttattcagttgtgcttacggtagatggcaatgaaatatttcgtagcaccgtagatcgtttctcgcaggaagagaaccggatgattaattcctggacttacgggcaatatatgaaatctttcattgatccgggcaacactttgcgtctgctaaaagcatcgaatgataaccgtggcttggtgacgattgatgaggaacgggactatcagttcttatatacattaaaagatgctttcggaaacacttccaaatatagtttcaccgtacggggtcggaaacagccgattgaaccgttgaatcatcgggagaaatattattttacctggaataagactaattatctgcaagaaccgggattgaacttggttgttccgaaaggaatgttgtatgatgatgttcccctcaattatcaggtgaaggcggatagtggtgccgttgcttttacttatcaactgaatgataaggcggttccgctgcatgcagcttgtgaactgtgtatcgggttgcgtagaaaaccaattgccgatacgacgaaatattatgtggcccgcataactccaaaaggaggaaagtacagcgtaggcggaaagtatgaagacggatacatgaaagcatctatccgggagttgggaacttacactgttgccatcgataccatcccgccggagattatccctgtcaacaagaatcagtggggaagaaacggaaaaattgtctatcgtttgaaagatcagggcgcgggaattgcttcctatcgtggaacgattgacggaaagtatgcgcttttcggacgtcccaatattgtgaaatcatactgggaatgtacgttggaccccaaacgcgtaaagaaaggaggcaagcatactgttgaatttacagtgaccgactattgtgggaatgaaacagtggcccgtgaaagctttatttggtaaattattaaaagtgaatcatatatttattatgaagagaagaattattctttgtgccgccgtattgatggcggctgtggcgaacaccttcgcctgcaccaacctgattgtcggaaaaaatgcgtctgccgatggctcgacgattgtttcctattctgccgactcgtacggcttattcggagaactttatcattatccggctgctacctatccaaaaggtacgatgctgaaagtttatgaatgggataccggcaagtatctgggagaaatagagcaggcacgccagacttacaatgtagtcggtaatatgaatgaatatcaggttaccattggtgagacaactttcggcggacgtccggaattggccgattctacagggattatcgattacggaagtctgatttatatcggtttgcaacgttcgcgcactgcccgtgaagcaattaagatcatgaccgacttagtgcagcaatacggctattatagcgaaggagaatcctttactattgccgatccgaacgaaatatggattatggaaatgattggtaaaggtcccggcatccgtggagcagtttgggtagctgtacgtgtgcccgatgattgcatttcggcccatgccaaccagtcacgtatccaccagtttgatatgaacgacaaggaaaactgcatgtactctccggatgtcgtttcttttgcccgtgagaagggatattttaatggagtaaacaaagactttagcttctcattagcctatgcgcctcttgattttggtgcccgccgtttctgtgaggctcgtgtgtggagctattttaataagttcacagataacggaaaagattatcttccttacattgagggaaagaccaatacgccgatgcctctttttgtgaaaccgaaacataagttatccgtgcaagatgtgaaagatatgatgcgcgaccattatgaaggaacgccccttgacatctccaatgattttggagccggaccttataagacaccttaccgtctttctcctctgaacttcaaggtagatggccaggaatatttcaacgaacgtccgatttccactcaacaaagcgggtttgtatttgttgcacaaatgcgggctcataagccggacccgataggcggtgtactttggtttggtgtggatgatgcgaacatggctgtatttaccccggtttattgttgtgctactaaagtgccggtatgttatacccgtgtagatggggccgattatattactttctcctggaattctgctttctggattttcaactgggtatctaatatggtctatccgcgttatgatttgatgatcggtgatgtacgggaagcgcagaaagaaatggaaactactttcaacaatgcacaggaaggcattgaagaaatggctgccaaactgctggcaaaagataagaacgcagcggttgactttctgacaaactatacaaatatgaccgcacagagtactttcgatacttggaaacaattgggtacattcttgattgtgaagtacaatgatggagtggtgaaacgtgttaaagacggtcagtttgagcgtaattctattggacaacctgccggagtgatgcgtcccggatatccgaaagaattcttgcaggaatatgtcaagcagactggtgacagatataaagtgccacaagaatagatattaagtatgagatattaggtattaagtatatcgctttttaattcttaattctcaaatttcaattaaaagaataggaattataaacttattattttacatttgtgtgctcaagaaattgataataaataattcattaaccaataaataacaatcgaaatggaaaatcaggaacttattaaacaggtcactgaaaaagccgaaaaatggctaaccccggcttatgatgctgaaacccaggctgaagtgaagcgtatgttggaaaacgatgataaaaccgaactaattgaagctttctacaaagatcttgaatttggtactggtggtctgcgtggtattatgggtgtaggtagcaatcgtatgaatatctatacggtaggtgctgccactcaaggactttccaactatctgaaaaagaacttcaaagacctgccgcagatttctgtagtagtaggtcacgattgccgcaacaacagccgtttgtttgcggaaacttctgctaatattttctctgccaatggtattaaagtatatctgtttgacgacatgcgtccgacaccggaaatgtctttcgccatccgtcacctcggttgccagagcggtatcattctgactgcttctcacaatccgaaggaatacaacggttacaaggcatattgggacgatggtgcacaggtattggctccacacgataaaggtatcatcgacgaagtgaatgcaattgcttctgctgccgatattaaattccagggaaatccggatttgattcagattatcggtgaagacatcgataagatttatctggatatggtgaaaactgtttctattgatccggcagctatcgcccgtcacaaagatatgaagattgtctatactccgattcatggtacaggtatgatgttgattcctcgtgcattgaaaatgtggggattcgaaaacgtatttactgtgcccgaacagatgattaaggacggtaacttcccgactgtcgtatctccgaacccggaaaacgcggaagctctttctatggctgtaaaccttgccaaagaaattgatgctgacctcgttatggcttccgacccggatgctgaccgtgtgggtattgcttgcaaggatgataaaggcgaatgggtactgattaacggtaatcagacttgtatgatgtacctttattatattctgacacagtacaaacaactgggtaagattaaaggtggcgagttctgtgtgaagacaatcgtaacaactgaactaatcaagaaaatagcagataagaacaatatcgaaatgcttgactgctacaccggatttaaatggattgcccgtgaaatccgtctgcgtgaaggcaaacagaaatatataggtggtggtgaagaaagctacggattccttgccgaagatttcgttcgcgataaagatgccgtatcagcttgctgtttgattgctgaagttgctgcatgggcaaaagataatggtaaatccttgtatcagttgttgctggatatctacgtagaatacggattctctaaagagtttactgtaaacgtagtgaaaccgggtaagagcggtgcagaagaaatcaaagctatgatggagaacttccgtgccaatcctccgaaagaattgggtggctctaaagtgatcttaagcaaagattataagacactgaaacagacagatgataaaggtaacgtaactgcaatcgatatgccggaaccatctaacgtacttcaatatttcactgaagacggtagcaaagtttccgttcgtccttcaggtacagaacctaagattaagttctatatggaagttcagggtgaaatgggttgccgcaattgttatgcttctgccgaatctgccgcaatggaaaagattgaagcagtgaagaaatcattgggtatctgattttgtttcttctgaaatttcagatatagataacgaaagataaaaaataaatagcgcctccatggtcttttcgaagattatggaggcgcttctttttctctatacatagctctgattctgcctattttcgggctttttccccaacttggcacagttctttcatttcctttgcattctttaagtccacttgctaatccttcttgcgagaatcttgttgtattgacatcatctcaatttcaacccgcaggctgcggatacacatgttttgttgatgctttagagtgatacgttcagtttcatattcgtaagttgttcgtttgtagttatgtgtatttcgtggcctgctttcttagtctatttttcagtcagtgctatttctttttttctgttatttcttcgtgcctatccaagtccatttatgccatattgtttccaatggtccttgtttatgtttagacagccaccatttgcagaaccgaacttgcgccaggaaaagaataataccgataatcaggctaagagtatatccacagtaaggagcaagatagaatccgaatgggaaatagataatggctcccaaaatagattgagaaatataattggtcaagctcatttttccgtagaatcgcagattagatacagttttcttgaactgatccttctgataaagcaacacgaaagaagcaacaagtacaatcgtaaatgcaaatttctgccacatatcaaaggcagtacctaccgtttgctgaattaaactgctgtcactttgcatgatctgttctttcagagaatacagtggcgcgaaactgatagctgcaataataagtgctttcatccagaacttcaaatgagattcggtagttacgaacaattctttgcgtccgatatataagccaaacaggaaaagtccggcagtctgtaagaaacgtccggcaccgatagcccaaaacaggcttgctttctgtcctaaagtaacattacctatcagaaaatcccaaaagtttccggctttggtgtattccgctacttcagcatacatggctccgacattcaaatcgggtagggtataggcaggattgaaaaggctcattatataatgaaaccattcaatcggttgcagtgaaaacaagatggcggtgattagaatcgctttgtcactccatttacgtacgataaatagtacaagactgactacaacaaacagaagcaggacatctcctgccgggaagaaagcagcattcagagtggcgaatcctgccagcaatatcattctccataaaaagcggtaaccaaaatcttttcctttcaactgctggttgtgcgactggatatagaaagtgaatccgaaaagcagagcgaatatggcataagactttccggcaagcagtgaaaatgtcgcattaaatactccggcatccaaaatggtgagccattcaggagaacttcccggatatacggggaaaatgaaatgctccaggttatgaaccagaaggatggccattacagcaaatcctctaagagcatctactacttcaattcggggtgtttttgttgataattccatggggctaatttatgattgttttttagttagtatttgttttacccatctattggcaggcttttcaaaataataataagaaagtaagctaagcgcaatagtgatgcaaaaaatgacggggacacttatcatccaatgtatgtgccattgatacagagtagccatttggaggtatgtgagtataataaataaatgtatcagatagaaactataactgatttctcctcctatcactaagacccgattggatagtaaccgggatatataccctctttgtaaggcaaagataagtatcaccaaagaaacgggtagccagtagtaacaagaatagcggtatactttgggaatgtctgcggcacaaaaatagaaaacaaaaaataaaatgactactcctatttctaatagtgttccggtggaataagaaatctttttgttgaatattgaccgataaaactgataaagtaaaacacctacaaaaaagtccggcaggcgggtgattggatttacataccagtatgctttaatttgttcttcagcagtcagatgcatacctgtcagcataatcagcaggcagatgaaaagagtgatacatagattccgtttactatttaagaaaggaatgatgagggggaaacagaaataaaataactgttcgcagcccagactccacgaaggactattgaatgagaaaaaataatctgcagaagggaagaacggttgcaataaaaaagtggaagcggcgaagtgttttatccagtctgtcgtatcgttgtattgaacataccctcctatgcatgcggcaattaatagagtaagtagatggagggggtaaatgcgggcaatgcgtgctacccaaaaagtacgtttggtggtgatcttttccaataacttttcttcataattataggcaataatgaagccactaaggatgaaaaaaaagctgactccaacaaatccttctttaaagaagtgtgtgtcgaagctcggatccagaacataacaatgtgccccgaataccatcaaggcaaataatattcgtaaagaagttaatgtgttaatcacgatacttatcagtttttttgtattcgctgacaaaagtactgttttcttgtgatataaaaattcacatagattaaaaagaatcaagattcagaccgtaggcggctaagatgttggggagtcatgcctagaaaggaggctatatatcccaattgggcacggtgaatgacatcgggttgctcacgtaaaagttgttcataacgttctttggccggaagatacaatcggttgatatggtgaatatccatgtacaacaaacattcctgatgaatgacacgtccccagttggcaatttctatattagtttcataaatctgatttaaatcttcaatacgtatggcatatagttcacaatcttccagtaattctacatattcgtatcccggttgattatgatataaatctttcatggcaaaggtaatatcaccttcgcgtgaaaaccagatcgtgatttcttctccgtcacgtaaacaataggacctacaaaaccctttttcaataaagtagacgtggcggtctagtactccaccgtgtatcagtaaatgttttttaggaagctccattttcttcatatagctgaagagtacttctaaagaactgtcggataccggataatactgacggattcctttgatgatattttccatgtttgatttattcatttggatgttctatccaccaatcaatcatctttcgggcaagactaagttttctgggaagttcgggtaaattgtctcttgtataaaagtctcccgagctcaattcttcatcttggaggttgatttcccctccggcataatcagcaataaagccgaccattagtccgctaggataaggccagggctgattaccgaaataagtgatattctttacatccagtccggtttcttctttcacttcacgtgctacacattcttctagcgtttctccggtttccagaaatccggcaacgagactgttgaatgttcctttaaaattgcgggcatgcactaagagtagtgaatctttttttctcactaatacaagaatcgctgtggaaatggaaggatatgcttcccggccacatttcggacaacgcttcatgatagattctttctgttccataggcgtgccgcaggcggaacaaaagcggctgtttctatcccaatgcagaatctcatgtgcttttcctgctgtctgataatgagacaaaggaagatattcataggaggcacgaagccctatcatgatccattgctccgattcttcaatgggagaggagagggagaaagccttgcagtttttcccttccagtgtagtgatattgtgtacggttgttttttctttaataacaataggagagctttctccacacgggatggcatatatggcatcttcttttttctcaagaagcagttggtctttgtaaaagataaaccaccatgattgtgctgtctgattcattttaattctaattcttgatcttcgcgctgcgaagttataaaaaaactagattgatatttagacttatcagataaaatacagggcaactgcaccaaaatttgattcataaccgtgcagaaatgagctaaatgataatttattggggtgccctgaaagggcttaattatatagcgtagggcaacgccctacgaaaaagacatggtgtaagataaatgtataaaagattaaggaaagagtataatgcgttttccctgtaaatgtgtaacttcatcataggacaactttaatcggctattcggacgattggaatcggctgttcagtcaactattgtcagccaaccggacaactccagtcggcttttcctaaacaagcactaaagatacgacaaagtaacgatatatcagcatagaaaagcttgtttttcgtttcagaagaaaataaatattttcttagttaaatacttgcaaaccccatatttcatgttataccttagcagcatcaaccggtcgaaaaaacaacatttattcatttaaaaaacaagaaaaatatgaagacattagaatataactcgaaacgtttggcaaaaagaatacaagcattgatgaaagaatcgtcaaacgtcatcgtttcaccgaacacttcaaagaacgtaccgaaaatgcaagaaatagatgaacaggaagcatataaacaagaagtacataaacaccccgtccttctaacacgacaagtgattgactttttgaaagtacgatatgacttccgctacaacttactcaccgaagaaaccgaatttcgcccctccgggcaacgagaaattcctttctgccgcatagacaagcgagaactgaatactttctgcctggaagcccacaaagaaggaatcaactgctgggacaaggaccttcaaagatacatttactctaccctagtggaaagctaccaccctttccggctttatatgaacgaactacctgcctgggacggaacggatcggttgaagcccttggcgaagcgagtatccgacactcctatatggataaaaagcttccacacctggatgctcggacttgccgcccaatggctgggagtgaatcaaacacaagcaaacagcgtagccccgatacttatcagcgaagaacagggacgccataaatccactttctgccgtatgctgatgccgccacaactagcccgttattattcggataatctgaaactaaccgcacaaggcaatcccgaacgtctcctagccgagatggggttactaaacatggacgaatttgataaattcggagcacaaaagatgccgttacttaaaaatctgatgcaaatgtccagcctcaacatctgcaaagcctatcagaaaaatttccggtcgctgcctcgtatcgcctctttcatcggaacaagtaaccggactgacttactgtgcgatccgacaggcagccgcagattcatctgcattgaagcggagcatgatattgactgtaccggaattgaacattcacaaatctacgcccaactgaaagaggaattgcttgcaggtgcccgtcactggttcaacaaggaggaagaacatgctttgcaacgtcataatagcgcatactatcatgtcaaccccatagaagacattgtgtgcaacatatacgcgcctgccatgttggatgaaccggattgtctgtcactctccgccgctatcattcatcaagaattgaaaaagaggtttccggctgtacttcgtaattgtactcctatccaattggcgcagattctgactgcaacgggtatcagtcgacagcatacgagattgggcaatgtgtatttggtgaagaaagtgaagggctgtgaagagtgagaatgatactacctgttcacataagatatctgtgaataagatggttacgcctctgtgacgactgtgaatgacagcatatatcatagcaatcagaaagtagtaaacaatcaagtcccgaacatattttgattggtaatgattttattgcaaataatgttattactaatcgaagtatttcttatttttatattcctctttaaagcttgcgccttttgtgccctgttgcgttttattttttattttgtaagtcggcaaggtctgcgtttctgaaaaaaaacaatatatttgcattcataaatatcgcaaaagtaagtagttacggtgatttttataaattttgttctcttttttcgcaggaaaagtgacagtatgaacgataaaattgacatcatagtagcgggagtaaaccggaaggataaaaagatgtggggcgatttctacgatcgtttttatactgctttatgtgtttatgtttccaagatattgccagtccccgatgcggtggaagatttggtacaggaagtttttatttctgtatgggaggggaagcgtaccttttctgatattaaagaacttaccaattatctttatcgtgcctgctataataatgccttattatatatacgtaataatcaaattcatgatactattttaagttctttggcggaagaagaaagtatggtggacgaagatacgatttatgcactgacagtaaaagaagaaattatccggcaactctattgctatatcgaagaacttcctgccgaacaacgtcggattattttaatgagaattgagggacatacatgggaagagatagcggaacgtctggagataagtatcaatactgtcaaaacccaaaagactcgcagctataaattcctccgtgaaaggttgggggattccattcattccataattctttttttatttttctaaaaataaaaaaacattctgatacttctttgtctttttattgattgattaaaatttattctatttgttaaaatcaaatctttttcttctatataatgacattatgatatatttctacctctaaattctgattcattattcttttatctcaaaaaaatgtcatctttttgtcacccgtttttatgagttgtgtatatctataataaagatgaattaaacaattgtttaattaaaaaaacgcaataagatgaagaagttcgaaaatgtatatcaagacgctgctttaatgagaaaggttcttttgggggaggctgatgaagtggaacaaaaagatcttgagaaacggttggcagaatgtccggacttacgaaatgtatacgagcagttacagagcggggagactttgaaagtcgcctttggagaatatcaaaaatattcgtcaaagaaagcttatcagtcttttcttcagagtatcgggcagatggaatcgaaaggccggaagagtcgttctcgtcgggtggggtggtacgctgctgcggctgtcgttactttagccgttgctctttctttctatatgtcgaattatatctcatcggaaaaagaagggaaaactttgattcagccgggaacgcagcaggcacaattgactttgtccgatggcagcgtgattgatgtgcatagaaaagaagtaagcgtagtagtagatggcgttcaagtaaaatataagaaaggagtgctgtcttatcagcctaccgtcacgacacaacatgaggagaaaaacattgaagaacaatctggcaaatcaaatgaactggtaataccgcgtggaggtgaaaatactgtaatccttgcagatggaacgacagtacatttgaatgccggttctaaattgacctatccggtacgttttgccggtaaacgtcgaattgtgcgtttggagggtgaagcttattttgatgtagcaggagatgagaatcatccatttgtggtacaaactcatctcggggaaataactgtacttggtactgaattcaacgtgaatgcttatgccgatacccctgtttgttatacaaccctagtacatggaaaagtgaaattctctacattaaatgcggaaacggttactctctcaccgggtgaacaagctgttgtatttgccaatagttcaacgaaacgcaaggtggatttggaagaatatgttggttgggtagatggtatgtacatctttaatgaccgtcccttgggcgatataatgaagacattcgaacgctggtacgacatacaggtttattacgaaacccctaacctgcgcgacattacctatagtggtaacttgaaacgctacggaacaataaattcattcctggatgcactggaactgacaggagaccttacttataaaatcagtggcaggaatatattgatatatgacaaagtggaagaacaggaatggaaaagatagaatattagaatagttagaatattaggtacacaaaagtttaattattaatttatgagagaaaaacgatggctgctatgttttctagtggcaatgtgctgtacgtttagtgcatgggcattaccgtcacaagacaagacggtgactttgaaactgcacaatgtctctatagagactgtcctggatgcagtgaaaaaacagacaggtgtgaatatgttatataattcacaaatgttcaagggtgttccttcggtatcacttgatgtgaagaacgagagatgggatacaactcttaaattagtgttgaatcctcaagggtttgactatgtgatgaaagacggtattgttgtcattcgaaaacaaaagcgtgaaaaccgtgtccgtggtatggtgacagactcacatggagagccgattcccggagctagtattattgttaaaggtactcgtacaggtacttctaccaatattgaaggtgaatttactttggacgtaaaaagtgataaggtggtgttggaagtttcttttataggtatgaagaagcaaactgtccaagtggatgctactcgtcggaaaacggttgaaattacattggtggatgatgtcaaaacattggaagatgtggttgtgaccggatatagcaatgtacgtaaatccagttttacgggtagttcgactcagatttcgggtgatgacttgcgtaaggtgtcacagacaaatataattggggcgatccagtcattcgatccctctttccgtttggtagataacgtacaatttggttctgacccgaatgctttaccagaaatgtatattcgtggacgttccggttttggcgttaaagaactggataaagatcagctttcaaaatcaaatttggagaataatcctaatttaccaacttttatcatggacggttttgaagtaagcattgagaaggtatatgacttggatcctacccgtattgagagtttgacggttttgaaagatgctgctgctactgctatgtatggttcacgtgctgctaatggagtggtggtaattactactgttgctccgaaagcaggagaggttcgtgtctcttataactttacaggaacgttggaaatgcccgatttacgggattataatttggcaaatgcatcggagaagctggaaatagagcgtctcgcaggattatttgataaaggacaagctaacattccatcgactgcggtagggatgaacaactattataagaaatacgctttaattcaaaaaggagtagatacggattggatgtctattccacttcaaaattctttcaatcataagcacagtatttacttagagggaggaacacctaatttgcgttatggtgtggacggttcatttaatatagcagatggtgtgatgaaaggtacagaacgtaatcgctatagtgcaggcttctctttggattatcgcatcaagaatttgcaagtaagaaactatgtatctttcgggcatacgaaatcgaaagaatctccgtatggttcgtttagtgattttagcggactacagccttatgactctccttataaagatgatggaacactccgggagaaactcacatattcgaaaattagcggacgtgacaataataatccgctatatgaagcaactttgggtaattataattggaactcttatgatgaggttattgataatttgagctttaactggtacctgaatgattactggacggttaaagggcagttcagtgtaacgaagaaatattccaaatcagagaagtttattgatccgctttcaagtaagactagtgttacaggttcaaaagataataatcttgccggtgatttgtatacgacgaatggagaaagtttggattggaattccaatgcttttttatactatacacgtagctttaacaagcagcacaatttgaatgtttcagcaggttgggaagcagcttcaggtaccactgagagtaccaatgctcattatcgtggatttccgtcgggtgagtttcactctctgaattatgcggcggaagtatataagaaacctactcgtactgagaataccacacgaagggttagcgtattagcttctgccaattatacgtggaatgatatttatttggtagacgcttctgtacgtttcgacggttcgtcagagtttggggcgaatcagaagtgggctcctttcttctctggaggtttgggtgttaatattcataactatgatttcttcaaaagtaacggatatatcaataagttaaaattacgtgcttcttatgggcgtaccggtaaagttaatttcccggcttatgctgcaacgacgatgtatgaaactttatttgatgaatggtatataacaggttatggggctgtattgaaagctttaggtaataaagatttgacttgggaaaagacggataagctgagtgttggtatcgaaacaaaaacgttccatgatcgcctgactgttgatttcgagtattactataataagacaattgacttggtgaatgatgtcactctttcccaaacttccggtttctctacttacaaagataatatgggacaagttgccaacaaaggcgtagaattaaaacttcgtgcggatatttatcgtgacagaaactggaatgtggcgttatggggaaatatggcgcacaataagaatgagattctgaagatttccgactctcagaaagcatataatgagagagtggccgcttattataaaaatgaagcactttatcaagaaacattagggctgtctcatggtgcggaatattcggtaccactgccacagtatgaggaaggagcttctctgacttcaatttgggctgtacgttcattgggcattgatcctactacgggtaaagagatctttttgaaccgtgatggctctatagctgataagtggaatgctgcgcaggaggttgtagttggaaatacagaacctaaatgtagtggtgctttcgggttgaacctgtcgtataagaattggactctgtttgcttcatttctttatgagtggggtggacaggaatacaatcaaacattggtcaacaatgtggaaaatgcggacttagtgaacaagaatgtcgatttacgcgtattgacggacagatggaaaaaaccgggtgacatagctcagtttaaagatattaaagaccgggggatgactactttgccaacatcacgtttcgtgcaggataaagcattggttcgattgaattcattgaatgtcagctatgattttaaccgtgactggataaaaaaacatctccgcatgaatctgcttcgtctggaagcttctacgagcgacttgataaactggtcctctattaaacaggaacgcggattgagctatccgagatcttggaaagtggaattctcattaaaagcacagttctaaaaaaaagaagaaaaaatgaaaaagatatatacaataatatttgtgtcatgtctagcagctatctcgttcagttcttgtagtgactggctggacgtgagacctgcggatgagataaaggaagaatatttgtttgagacaggaaatggttatcgtacagctctgaacggtatataccggaagttggcgactttcgatttgtacggtagtaatctgagctgggggttgatagatggctggggacaggtatatgacttggacaaagcccccgacagcggtggtggtaaagctatgaagaaattatcgaagtttttgtataagaactctgaacttactcctacaacagatgctatgtggagcgcagcgtggaatatcatagccaattgtaataaccttgcacagcaggtggcagaggaagatacaatgctgttctacaaacgtacgcaggagaaaaatatgattttaggagaagctattgccttacgggcgtatatgcattttgatttgttacgtatatatgcgccgtctttggctatgaatccgggagataggctttttattccttatgtggacaaatatccatcttatttatccgatcgacaaacagtcggttactgtttggaacgcatcatcgctgatttagtagaagcgcaaaagattttgaaggatgtggataagtcatcagagtttacttcgggtaatcgttttactaagtctccttccggagaagaacgttttgtgtggtacagaggattccatcttaattatcatgccgtaactgcggagttggctcgtgtttacttatatgcaggacaatcggaaaaggcctatgaaacagcgaagttactaatagatattaatgctgataaaggttattataaggcagtaacaagtagttatagtggacctatgaatatagagaatgggaatataaagatgtatgaagacattatatttgcattatattctacagatcagactgattgggatttggagattaatcatgcaagtgataatgctaccaaaccggatgatgaaaagtatctggctttgagtgatgctgtgataacgaaattcttcggtaccgaaagcgataaagactggcgtcttaagtatcagttaggaccgaatacttcttctttttatcgttcattgaagtataaaaaacaagatgaaggttctggttttggtaaagtgaatagtacaatggtgcctatgattcgtatgtctgaagtatattatatagctgcagaggctatttatgatacagataaggaattggccaagacatatcttaaaactgtgaaacaagggagaggtattagttctcctgaccttagcaaatcgggtacgaagcaagactttattaatctgattgttgatgacgcccgtcgcgagtttattggcgaaggacagactttctttttatacaagcgtttgaaacggaacttggaagggtcggatgaaaagcagtccgtagaatatccggcgattgaagataatttggtgatgccattgcctgattcggaaagcaatatttaaattttgaaagattgaagatatatgaaaagaataagtttttatatagtcattgtattgttgggagtctccttctttacttcttgtgaggagcaaggattactgacccatacaaatgatgtgtcatatattgcatttgagaaaaatatgacaacagatacaacaggtgtatcttttaagttttacaatgaaggtgaaaatgctaagatattattaggagttaccatttctggaaaagtacaggataaggatttggagtttacggtcagtgtagatccggaacgaacgactttgcctgctacccaatatgaattgccagagaagtgcgtaattaaagcaggagaactaaccggagaaatattggtggttctgaagtattacgaaaaattggatacgaaagctgaactgctgacgttgcaagtgaatgacggtggtgaggttcgtcaaggtccgagtgtctattcacgtgctattatttccgtatctaatttgttgtttgcacctgagtggtggactagaaacgacggtgatgtgaataatccctacaacattgttgaagaatggtatttggggaggtattcggaaaagaaatatttaatgtttttggaagaattgaaaaaagacggggtggtatttgacggaaaagatatgtttatattgcgtaaatatgcactgcgtctgaaaaatagaattaaagattataatactcaacatccggatgaacccatgagtgatgagtatggtaaaatggaaattcctgttgccggataattaaaaaacggaagaagtatgaaaaagataacagtttatattttattactacttttattgagtagcatttgcagttgcctggatgataaaaacaattatgattatacaccgattaatgaactgaaaggcactattagtaatattgaaaaaaactatagtgttgggatagatgaagacttagttataacacctacgtttgagtttacaattgataaaacagatccggatgtgagttacgaatggagactagacggagaattgttgaatgtaaaagcaccttcgtatactttcaattctcataagatcggattgtttgaactcacattttccgtcatcgacaataaaacaggggttaagtactctgcttcaacagacattttggttcgttctccttatcagagaggatgggtggttttgtctgacgtagatggaaagtcaacactttcatttatcaagattaagaccttgtatggtgtgtcagaaactgtgaatatctggggtgagaaagtggtacgtgattctatcgcatatcattctgtcgaaaagtatttagtcaaagatttaggaaccaaccccaaaggtgtttttgagcatttgggttatcctagtactttcggacaggtagagactgtatatgatgaactggtagtgatgcaagatcgttgggtggagctgaacggtaatactttggagcgtgaagtatatacagaggatgagttctatggggatttgccggtgggaggcttcaaacctgtagaagctgccatgtcttactctgcaaaatttattcgtgatgaaaatggatatatttatatgcacacgaagccggttgcaaatgattttcatgctggagcctatatgtctattccactgtggaattatactaaattcagtgctttatatcctgtacagaagtttaaggacagaaatatggatgcggttctggctctccgtgaagaggataactcattggtaattattcgaaatggaggtggggtgaagaatagttccaatgatccgacattttatgataatacggtgaaggataccggagaaatagttgaatttgaaggagaggatgctaagaactttcagaatatgcgtgatgaaagtattgtaacaatgaaaactgcgtcagttaatgtgaatggcgacatgatgcaagcatgggttgccttgatgaagggtaacgatatgtcttatcaattgcgctatttcagaatgaagaataaaaaatgggatatatatgattattatgaaaatgacttgacgtcattgaaaaataaagagtatacagatatggctgtatttgaacaaaagcagtatgttgttattgcaatggggaatgaattgtggtattgccaatatgtgaaaggtgtggcatctgctccaaaattgattcatacatttgacaagaaggtgattgctctttcatctaatgatatatatttgtatccaaaatatggagtttacaacggtcagttaggggttgccttggaagacggaagtttctttatatatggggtggaagagaaggacaagcaagaatctggattggttaatgatgtaaaaataaaacaattatacccgaatgaggaaagtgagaaggagggagataataattttggaaaaatagtggatgtactatataaaataggaaatgctaaccagattgttcagtatgacctttaaaataacttgatctatatagattatgcggggaatcgcattgagtcttgaatactttatgtgattctcctttgtttatttgaatatgagaaaaagaatattatttatagttttatttgcttggtcaggcattctgcatgctttttcccaacagcaggccaactatgaattggcaaatgaatttcaggctttcggtttagggggtaattttactgctaatagtctaaatctctggccgaatgaaattaatggaacagataagttttggtttgaatttcatacgactgtcgggaaggattactattttgtagatcctgaacgtcggttaaaagaaccattgtttgataaagggaaactggcatcgggaattgcacagattactaggggtgtagtggacaggaataaactggagttgagtgatatcaaattttctgaaaacctggcttctttttctttttcttataaaggtaggaactatgaatataatcgcctgacacaccagattgtagagaaaaagaaagaaaagagtcggtcattatttgatcgttactcatggatgaaatattcgccagacagaaaatatcttgtgtatgtgaagaaacacaatctgtatgtgaaaggtaatggggagatgggaatggatacgacggaagtgcagttgaccactgatggagttcggtattattcttatgcgcatgatggaggaacggacgaagaaggagaagtcatgtctgatatctgttggtgccccgattcaaggcatctttatttagtacgcgaagatgaacgtctgcttagagatttttgggtgataaattcgttggatgacaggccttccctgactacttatcgttatgaattccctggtgataagaatgtaacccaaaatgaactggttatagttgatgtgattgggcgtaccgtaaaaaaaacagacataagtaagtggccggatcaatacataaatcctttgtgtgtgacaaaggatagtaaatacctcttttttgaacgtacgaaacgtacatgggacgaagtggatttgtgttctgtcaacctctctacaatggaggtgaaagaaataattcatgaagttgacaaaccgtatcgtgatccgcatgctcgtagtgtcgctattttgaatgatggtaaagatattctttttcgttcggagcgtacgggatgggggcattactatcattatgatggtaatggaaagttgaagaatgtgatgacttccggtgagtgggtggcaggtcagatagcttctattgatactttggggcgaacagtatatctatatggatatggcagggaaaaagatattgacccatcttattacatgctctataaagtgcatattgatagggaaggagtaactccattaagtacggaagacggtcagcatcaggttaaattcctgaagtctaatagatactatattgacacttattcaagagtggatatggaacctaaaatcatgttgaaagataacaagggacaagggattcttgaattggcaaagccggatattgaattagtctacaaagccggatggaaaaaaccggaacgttttgttgtgaaggctgctgataatataaccgatttacatggagtaatgtggaaaccggcagactttgattctactaaggtatatccgattatttctgtggtatatccggggccttactttggtcaagttcctacttcatttaccttagaagacagatgttgtacccgtttggcgcagttaggttttatcgtaattgctgtgtctcacagaggagatactcctatgcgtggaaaggcataccatcggtttggttatggtaatatgcgtgattatccattagctgatgacaaatatgctattgagcagttagctcggaggtattcatttattaatggtaaaaaagtcggtatctacggtcattccggtggaggatttatggctgctgcagccatctgtacttatccggacttttataaagctgctgtctcctgttccggaaatcatgataacaatatctataatcgtgggtggggagaatgctataacggtgtgaaggaagtggaaaaagtagtaaaagatagtttgggtaatgagacaaaagagtatggatacaagttcaatgtgaagccgaatacggagattgccaagaatttgaaaggacatttaatgctcgtcaccggtgatatggacaagaacgtgaaccctgctcatacttatcgcatggcgcaggcattgattgaagccggcaaggattttgatatgctggtgattccgggtgccggccatggatatggttctgctgataagtattttgagaagaagatgtaccgtttctttgccaagcatttgctgggtgatactcgtgcagactattggggagatattaaccgtaacaaataagacaatagataagattttatgaaaaactctctctttagatatgtgtgcctggtggttgcattgttgatatgtagctttgccgatgcacagcagaaagcgaattataagttagcggaaaagttccgtctgttagaacagaatcctataataaagtattcaacagaagtcaagccaacgtttattaatggtacggactgtttttattattcgtttactacacgtgaaggaaagaagtattattatgtaaatccgaagaaaaaggaaaaacgtcttctgtttgatacggctgaattattgagtaaaattgcagtatataccaagaaagcctattcttcggcagatccatatttgtctttcactttcatgaaggataacgaaacgattcgtattgattttgaccgtggactttatacgtacaatattcatacgaaagcactgaagcagcttaatgagaaaccatcttatggaaatagtgatccgtattggatgaagtattctccagatagtctttattttctttatgccagcaaggataatttgtattttgttgggaatcaaaagaaagggcaagataccattcctgtacaactgacaacggacggtgagccgaattatacatttaaccgtgaagatgagggtaagctggaaggacgcttcggagccgaatctactcattggattccaggtagccatcgtttttatgctgttcgtgaggataacaggaaagtgcgtgatttatggttaatcaattcgttgtctactccatatccgacactgaaaacttataaagccgaactggcaggcgataaacatgtcacccaatatgaattgttgattggagatgtcgatacccgtgaagtgaagaaaatcgatattaatcgctggcctgatcagtatattgacatattgtatatttcaaaggacgggaagcgtttgtatttccaacgttataaccgtccatggaaccagtcggatatttgcgaggtagacgtagaaaccggaaaagtgcgcgtagtgattcatgaagaaaacaaaccatatctcgattatcagatgcgtaatgtttctttcctgaatgacgggaaagaaatccttttccgttccgaacgtaatggttggggacactattacctgtatgacacagcaacgggaaacttaaagaaccaactgaccgatggaatatgggtagctggtccggttaccaagattgatactatcgggcgtaagatgtatttctatggttatggtcgtgagaaaggcattgacccttattattacattctttatgaagctcaactggatcgtccgaatgctgttcgtctgttaactccggagaatgcgtcacatgatgtcagtatctctccgtcttaccgatatatggtagattcttattctactgtttcgcaggaaccggtgaatgtggttcgtaaccggaatggaaaggtgattatgacgttggaaaagcccgatttgcagcctgtctatgagatgggatggaaagcaccggaacgctttaaggtaaaagctgccgatggagtgaccgatttgtatggcgtgatgtggaaacctgccgactttgactcgacaaaggtttatcctatcatttcgaatgtttatccgggaccgttcttcgaatatgtgccgacacgtttcacgattaatgatgtttataatacccgtttggctcaactggggttcattgtaatcactgtggggcacagaggtggcactccgatgcgcggaaaggcttatcatacctatggatacaacaatatgcgtgattatccgttggcggatgataaatatgctattgagcaactggctgcccgttatccgtttattgatgccaccaaagtcggtatttacggccattccggtggagggtttatgtcggcggctgccatttgtacttatcctgatttctattcggctgctgtttcatcggcaggtaatcatgacaatcgtatttataataaaggctttgttgagattcatttcggtgtagatgagaaggtgaaaacgactagagatagtttgggagtagaaagtacgatgtatgattatagtgtccgtgtacgtccgaatcaagagttggtaaagaattacaagcacggcttgttgctgtttaccggtgcgatggataaaactgtgaatcctgctaacacattgcgtctggtggatgcattgattaaggctgataaggatttcgaaatgtttgtattgccgaaatgtacacatggattcttcggtgagtctgaggatttcttcgagcataagatgtggcgtcactttgcccgcttgttattgcatgacaactcggctgattctgatgtcgatttgaataaggatatgattaaagatgacaggagaagataagatgaaccggatatttgtatatatagggattatagcaggattgttgctggggggaagcttgtctgttgaggctcaaaagaaaccgttggatatagaagcatgtacatcttggaaacgtattgatgcaccggatatttcaccgacaggcagatgggtgacttaccgtatatcgttgatggaatataatccggctagcaaggaagaaaaaaaactgcatttattcgattcccgtacgcggaaggaaatattgctgaatggcgatatagagcgtctggagttttataataacgaccagggagctttttatcggttggcagactcggcaggagtaatgaaaacatttttgttgtcattgccttcgggagtaaagaccgaatggaaacataaagaggcttttcgtcctgtggaagggaccccttactcaatctctgtaactaatgtgtcgaaagatacggtaaatcatgttccggcttttaacaggctggtggtacgtcatctgaagacagaagttgcttttcatattgacagtatcggctatcatacattatatgacggaggacgttctattcttttcattcgtaaaaagtcagacaggaacgagctatgctatggccctttagctggtccatataagactctttatcagagttctgtaaagagtgaaccctcttcttatagttttaatgaaaaagagatgatcggggagtttagcgtaaatgattctttgtggtatgctttttcattaaagaagccgggttgtaacttgctttttgaccggaaagaaattgttttgcctgatggtatgtctgtcggacgtattgacttgtctaaaagccataattttttgatacttgaacttcgggactcacagcagatttcccgtagaagggaagaatcggagaagaaaccggacaagagttttgaattagagttgtggacgtggaacgaaatggaagttccgactttacaaaggggcggacgttataggcaagataagtcggtgacgtatatttatgatattttttctaagaagctcacagaagttgctccatttaccgtagatttactcttaccatcgggagcagagaatttgaactatgtgctttacacagatgaatctccttataagatgcagcgtgagtggttggatcggttgccgttcgatatatattcagtgaatgtgcatacaggtgcaaaacggttgatcggacgtagttatcgtacagctcccaaatggtcggtaaatggcaagtgggcagtaatgtatgatccgattgctcaagtctggaataagtttgatggtgctaccggtaaggttgttaatatatctgatgctatcggttatccaatgttcatggaaagttatgataaaccggctcctgctcccgcttatggaatagcagggtggacggctgacgggaataatgtgtttctgtacgatgcatatgactggtggaagattgatttgacaggagaacgtcagccggagtgcctgactaaaggatatggtcgcaagcatggcaaatctattcgtaaaatgacgagtaatatagataaggatgtttttcagaaagacgaaaaagtcatagttagcctttgggataaagacacgatggatgagggtgtctatcagcttgatatgaaaggccgtctgagaaaattgatggaggggaattatgtatatactatacatcgtttttctgacaatcatgagtattgcgtttggaatcgtcagaatgtatcggaatttagggatttgtggtggagtaagtccgatttctccaatcccgttaaagtgacgaatgcgaatcctcaacaagcagattataaatggggtacagttaaactgataaagtggactaattatgagaataaggaaaataaggggttgctttatcttccggaagattatgatcctcaaaaagaatatccggcgttggtgcagttttatgaaactcattccggtgagttgaatatttatcatgcacctttgttgagtagtgcgttaggggatcctatgtattttgccagcaatggttatattgtgtttatgccggatgtgcatttcacggttgggactcccggtcagagttgttatgatgctgttgtgagtggaacgaagtatctgatagagcaggggatagcacatcccgggaaaataggcttacagggacatagctggtctggctatcaaacatcatatttggtgacaaagacagatcttttcacttgtgccaatatagcggctccaattacggatatggtgaccggatatttgggaattcgtaatggaagcggtctgccacgatattttatgtacgaggaaacacaaagtcgtatgggaaagactttatgggaggcaaaagataagtatctggcaagttcagcaattttggaggctgataagatacatacacctttgttgatattacataatgatgaggatgaggctgttgcatatgaacaaggacgtgctctttatttggctatgcgtcgcttacaacgtcctgcatggttgttgaattacaaaggtgaaggacatttcgtactgggaagaggtgcacagaaagactggacaatccggatgatgcagttctttgactattacctgaaaggaacaaaagaaccacgttggatgaaggaaggtattcatctgcgagagcgtggaattgatcagaaatacgatttactaaaaaaataaatattgatttaagatgaaaaaattattgattacggctatggctctgtcttgtttcgctttaagctacggacagaagaaagtagaaaaacagattatcggaaaatggtgcaatccttatacatacaagtctacgggtgagttgaaaggatttgagttcaagaaaggtggtaagtgttctgctatcaatattccgtctttagatttgaaaacgtggaaagtggataatggttatctgattgtggaaggattcagcaaggaagatgatggaaaggttgaggtgtacaaaactcgtgagcgtatcggctacctgacatcggattcattgcagttgatagtgaacgaaggaactcctcgtttggctttcctgtacctaaatacaaaatcaattaaggaactggttactcctgaagtgaagtaactccaaactattaataaattgactaaatctctctcttaataatttagtgttaattagcataagctaatggagtgcctcggcgtagtgattacgccggggtttcttttttatgaaaggcgaattgaaaagcagtgtacgaattgaaagcaatgagcgcttatcgcaacatccccaatgccttattctcagctgcttccataacttcccgttctccgggacctttatcattaatgccgcacaaatgaagaattccgtggataatcacacgatgtagttcgtcttcgtatgaagcaccaaactgttccgcattggtgcgtatcgtatccaggctgatgaataagtcacctgatagacgatcgccttcacaataatcgaaagtaataatgtccgtgtagtagtcatgttgcagatactgacggtttacctccagaattttttcgtccgagcagaagatataagcgatttcaccgagtctttttccgtaagaagcagctacggtctttatccattccgtagtctcacgtttcttgatatcaggcatttttacgccttctgtttgataagttacagccatagttgaatgttatgatttaaaagaaaaataaataactgattaagatagcggctatgatacccgaaaagtcagctatcagaccgcaagtcactgcattacgagttttggtaattcctacactgccgaaataaacggccagaatgtagaatgtggtatctgaagctccgcgtactatgcaactcatacgccctacaaacgaatccggtcccagttctttcatcgtatcaatcatcaatccgttggcaccgctaccgctaagcgatttcatcaatgcagtaggcagtgcccctacaaagctcgtatcaactccgcatgagcctactatgtagccaatgcctcccactagaaaatccatagctcccgaagtgcggaacacggcgattcctacaaggaaagcaaccagatagggtatgatacgtacagctgtcgtaaatccttctttagctccctctacaaacgaatcgtatacattgatttttttcctgactcccgtcagaataaacaggataatgacactgaacagcagaatattcgctatcaatgtagaataagtacccatatcctctcgtgaaacgcttagaaacagataaatcaatcccgaaaagaaaagacagataacacccattaaaatgagaataggcttattgattaagtttatcttttgagcgatactgactgctatgactcctactaaagttgaaatgaaagtacttagcaggatagggataaatacatccgtaggctgtgcagcccccatttgtgcacgatacaccatgatactgattggaatgatgataaggccggatgtattaatcaccaaaaacataatcatcggattggaagccgtatccttattcggattcagttcttgcagttctttcatcgctttcagtcccagcggggtggcggcattgtccaaaccgagcatgttggcagacatattcataaagatggagcctaacaccggatgccctttaggaatgtccggaaacaggcggcaaagcaccggactaagaaagtgggccagcgcattaatcaatccgctgttctcgccgattttcatgatgcccaaccaaagggccagtacacccgtaagtcctagcgatatctcgaatgccgttttggaggagtcgaatgtagagttcatgatagccgtaaatatccccgtatctcccaaaacaatcacttttataagagcgatgataaaggctatgacgaaaaatcctatccaaatgtaatttagaaccatagttgataacgtgtatatagatagtgcaaaagtagttattacgtttcaaataaactaaatcttcgtctttcttatactgaaaatgaatgtaaatctctatctttgtctcctactttcaagaaataaatggaacaggaagattttaacatacgcgaacatcagcttacttcaaaagaacgggatttcgagaatgcactccgtccgttaagctttgaagactttagcgggcaggacaaggtggtggaaaaccttcgcatttttgtgaaggcggcacgtctgcgtggcgaagcactcgaccatgtgctgttgcacggccctcccggattaggaaaaacaactctttcgaatattatcgctaacgaattaggagttggctttaaagtaacttccggtccggtgctcgataaaccgggggatctggcaggagtgttaaccagtctcgaaccgaatgatgtactttttatcgatgaaattcatcggttgtcacccgtagtggaggaatatctttattcggcgatggaagattaccgcatcgatattatgatcgataagggaccttcggcacgcagcatccagatagatttgaatcctttcacgctggttggtgcaaccacacgtagcggtctgctgacggccccgcttcgtgcacgtttcggtattaatcttcatttggagtactatgatgatgatattttgagcaatatcattcgtcgttctgcgtccatactggatgtgccttgttcggtacgtgcagcatcggagatcgcttcccgtagccgcggaacgccccgtattgccaatgccttgctccgtcgggtacgtgattttgcgcaggtgaaaggctccggttctatcgatacggagatcgctcagtttgcattggaagcactgaatattgataagtacggcctggatgagatagacaacaagatactttgcaccattatagacaaatttaaaggtggtccggtaggtatcactaccattgccacggctttgggagaagatgcgggaaccattgaggaagtttacgaacctttcctgataaaagaaggatttatgaagcgtactccccgtggacgtgaggtgaccgaacttgcctataaacatttgggaagaagtctttataacagtcaaaaaacgctgtttaatgactaacataaagcgtcatgtgacaagtggtattaacggtataaaagaactttataaagcatagttggatgatgaagcaatggactactttacttgtttttctctttttgagcttgtctttatcggctcaacaggaatatgggagggatatttttgtctcttctaaaggagactctttaccttatcggatgattcatcccgaatcggtgaagccaggtgaaaagtatccgctcgtactgtttctgcatggagccggcgaacggggaaatgataatgagaaacagttgactcatggtggacagatgtttcttaatccggtcaatcaagagaagtatcccgctttcgttctaattccacagtgtccgacagacggttactgggcttatacaggacgtccgaagtcgcttatccctacagaaatgccagtgggacaagagatcagtcctatattgcaaacgcttaaacagttgctcgactcttatctggtaatgcccgaagtggacacacaacgggtttatattatcggtctttcaatgggagcgatgggaacgtatgatttagtcgtgcgttatccggagatttttgcagctgcagttcctatttgcggtacagtcaatccaagtcggctatcggttgccaaggatgtgaaatttcgtatctttcacggagatgcggacgatgtagttccggtgaaaggttctcgcgaagcgtataaagcactgaaagctgccggtgcagatgtggaatatattgaattccccggttgcaatcatgggagctggaatccggctttcaattatcccggatttatggattggttgttcaaacaaaagaagaaacgttgaaccaatctaaatgataattactaataaaacatggctggactaaaatcattagctaaagatacggcaatttatgggttgagtagtattgtcggacggttccttaactacatgctggtgcctttgtacacagcggtattgccagcttccaccggaggttatggagttgtttcaaacgtatatgcgtttacagccctgatgcttgtactgcttacgttcggtatggaaacgggattcttccgttttgccaacaaatcgggagaagacccgatgaaagtatatgccaactccttgttatcggtaggaggggtatctttgatttttgttttcctttgcttgttattcctgcaacctatttccaatttactggattatggcgattatccggagtttatagcgatgatggctgttgtggtagctttagactctttccaatgcattccttttgcctatttacggtataaaaagcggcctattaagtttgctgctattaaactgctctctatcgttggtggcatcggtttgaatttatttttcctattggtgtgcccgtggctgaatgtacattgtccgtcaacgatctcctggttttatgatccggattatttagtgggatatatctttattagcaacctgattatttcggttgtccagatgttcttctttattccggaactgacaggttttgcttataagttggacaaggtattgctgaaacgaatggtcgtatattctttcccggtattaatcttaggtttggtaggtattctaaatcagactgtggataagatgatctatccgtttctttttgaagaccggcaggaagggttggtgcaattgggtatctatgcagcaaccagtaagattgcgatggtgatggcaatgtttacgcaagctttccgttatgcttacgaaccgtttgtctttggcaaagaccgagaaggagacaaccggaagatgtatgccgctgcgatgaagtattttcttatattttccttgctggctttccttgctgtcatgttctacctcgacttgctgcgttatctggtggcaaggggttactgggaaggcctgggggtagtagctattgtaatgcttgcagagatctgtaaagggatctatttcaacctttccttttggtataaactgacggataagacctattggggagcctacttctcggtgattggttgtgttattattgtcgtattgaacatcctgtttgtgccggtttacggttatcttgcttcggcatgggcttctgttgcaggctatgcagtcatcttgctgctatcctactggataggacagaaagaatacccgattcattatgacttgaagagcctgggactttatgttctgctggcagcggtactttacattattggagagcaggttcctatccctaatatagtgctccgtctcgctttccgtaccgtactcttattgctatttatagcttatattatcaagaaggatttaccattgagtcagattcctgttattaatcgatttataaagaagaaataactatgaagacagatgaacgtaataagtttgctatcaagtcctttctgggagaatatctggacttgaggaaagataaggataatgaactggccacagtggattctatccgtaagggggtagagttcaaaggtgccaatttatggattctgatctttgccatattcatggcatcactcggattgaatgtgaactccactgccgttattatcggtgccatgttgatttctccattgatgggacctattatgggagtaggactgtctgtcggactgaatgactttgaattaatgaaacgctctttgaagagctttctcataacgactgctttcagtgtgactacggcaacaatctttttccttcttgcccctattgccggttcacagtcagagttgctggcacgtacatcgcccactatttatgatgtattcatcgcgctttttggtggtttggcaggtgtcgtggctctctctaccaaggaaaaaggaaatgtgattccgggtgttgccattgctactgcattgatgccgccgctttgtacggcaggttacggactggcttccggtaatctcatttattttctgggtgctttttatctttactttatcaactctgtttttatcagcctggctactttcctcggtgttcgtgtgatgcatttccaacggaaagagtttgtggataaaacccgtgagaagaccgtacgtaaatacatcgttctgattgtagtgcttaccatgtgccctgcagtttatctgacatttggaattataaagagcactttctatgaagcagcagccaatcgttttataaacgatcagttgagctttgagaatacgcaggtacttgataagaaaattagctatgaccataaagaagtacgggttgttttgattggtcctgaagtgcctgacgcttcgatatctattgctcgtagcaagttgaaagagtataagctggaagatacgaaactgattgtattacaggggatgaacaatgaagcggtagatgtatcttctatccgtgccatggtcatggaagacttctataaaaacagtgagcaacggcttcaacaacaggcggtgaaaatttcccaactggagacaacactggagcaatacagaacgtacgatgctatgagtcgtacattagtacccgaattgaaggtgctttatccttccatcacaactttttccatcgctcactcgctcgaagtgcgggtcgattcgatgaagacggatacggtgacattggctgtccttaaattcgccagacatccgtctgttgctgaaaaagagaaaatcagcgaatggctgaaagcccgcgtaggaacgaagaagttgaggctgattacagaataatgaatctaaaaataataatatgaagttcagactaaccgtcttgatagtcttttctctctgtctgtcgaatgtatttgccgatgagggaatgtggttgttgggaaatctccgaaagaataaacagactgaccgggtaatgaaagaacttggtttgcagatgcctgtgaataaaatatatgatccgaagaaaccatgtctggcagatgctgttgtcagttttggaggcttctgttcaggagtggtggtttctgaagacggtctggtgtttactaatcatcattgtggctttagcagtattcagcaacattcttcagtggaacatgattatctgaaagatggtttctttgcacgtagtcttgaggaagaactgccgaatccggaattgtatgttcgtttcctgcttcgtacggaagatgttactaaacgcgtattgtctgccgcccggcatgctaaaacggaaacagaacgccgtgtggctgttgattcgattatgaatgtaatcagtatggaagtctccgaaaaggattctacattgactggtattgtagatgcttattatgcagggaatgaattctggctatctgtttatcgtgattataatgatgtccgcctggtttttgcacctccttcttctgtcgggaagttcggatgggatacggataattggatgtggccgcgtcatacgggcgatttcagcgtatttcgtatctatgctaataccaagaatggtccggcggattattctcctgaaaacgtcccttatcatcccgaatatgtagcacccatttctttggatggatacaaagaaggttctttctgcatgacgcttggctatccgggcagtacggaacgttacctttcctcgtatggtatcgaagagatgatgaatggaatcaatcaggcaatgattgatgtacggggagtgaaacaaaccatctggaaacgggagatggaccgtcgtccggatattcgcattaagtatgcttcaaaatacgatgaaagctccaattattggaagaatagcatcggaacgaataaagccatcaagcatttgaaagtgttggaaaagaagtgggtggctgaagcagagcttcgtaactggattcagtctcatccggaagagagagagaaactgattcgtttattttcttctttagagttgagttatagtaatcgccgtgaaaccaatcgtgcgttggcttatttcggtgaatcgtttataaatggtcccgagttagtgcagctcgctcttgaaattctcaatttcgactttgaggcggaagagaagttggtgataacccgcatgaaaaagttactggagaagtatgataatctcgatctttccattgataaggaggtttttgctgccatgctcaaagagtatcagtcgaaagtggataaaaagtttctgcctgctatgtatgagaagatagatacgctctacaacgggaatattcagacctatgtagactctttgtatgcaacttccaatataacgtctcctaaaggcttaaaacgctttctggagcgagatactacttataatctcatagaggatccggttgtttccttaagtctggatttgattgtgaagtattatgagatgaatcaaagcatttccgaggcttccgagcagatagaggagggggagcgtttgttcaatgcagccatgcgccggatgtatgctgatcgtaatttttatccggatgccaactctaccatgcggcttagtttcggaacggttggaggatatactccttttgatggagccacttatgattactacacaaccgtgaaaggcatttttgagaaagtgaaggaacatgcgggtgatattgactttgccgttcagccggagttgttgagtttgctttcttccggtgatttcggaagatatgccaatgcgcagggagatatgaatgtttgttttatctccaacaatgacattacaggcggtaattccggcagtgccatgtttaatgccaaaggagaattactaggcttggcttttgatggcaactgggaagcaatgagcagtgatatcgtattcgaaccagatttgcagcgttgcatcggggtagatgtgcggtatatgctctttatcatagagaaatacggtaaggcagcccatcttattcaggaattaaaaatgggtcgatgaagtaaatattccgatgaaaccgcattttttatcgttttaatataataacgattacggcagcgataatcagtgcaatacctacaccaatgcttgtggtgaaggcttccccgaaaagaaagatacctacacatacagcagttaccggctccatagctcccaacacagaggtgagtgtggagccgatgctttttacggctcttactagagcaagattagaaactacggtagggattaaagctaatagaatcaagttgccggcagtatgccatttgctgatgggttgaagctggctgatggtttccgttccgataaaaaggagaatacctccgaaaaggaatacgtagaaagtaagcagtagccccttcatctgtccaatttttagttggctcattgtgacgagataaagcgcatatccgagtgccgacagaagaacaatgaaaagtcccaggaaagaaaagcttcccgtttttgtatctccgccggataagaaataaactcctgccactgcggatgcaatggcagcgatccgccagccggacttcttttctttaaagaagagcatcatgattaacgtggtaagcaccggatacatgaaatgaatagtggtggcaactccgctagccataaacttatatccccagaacaggaatacggcagacattaaataaagaagcgcaagaagaaacagggaaggaatgtcctgcctcttgatgcgaaatgattgaccattcaccaataagattccgcctaacgccagacaggcaaacaggaaacgatagaaaagtatcgattcaaattgcatccctgcttgcatggcaggaatggtaaatagagggataagtccaaaagaagccgatgaaagcagcccatatagtaaaccattaactttattcatagtcaagtatatattcgggccgcaaagatatagcttttttgaggcaagtagataaagcgtccatacaatatttttcgtaaattagcacgcgatgtaaatatggcattcgattgaaagaaaatacaaactaatttttggataaaatgaaacgattgacactattaccgggattactatttttaatgctgcaagcagcattttcacaagagtcaggcagctgtaaaccagtgaatctggtttgtgattatttggtgaatcccttgggaatagataatcctgctccccggttatcatggatgctgaatgatgctcgaaaaggagcacggcaaacagcctgtcaagtcatcgtagacaaagactctcttgaattgattgcagggaagggaactatctgggattcgggcaaaaaggactccgaacagattctgattacctattccggacaggaacttcgtccttttaccaagtattattggagagtgaatgtatgggataaggatggagtgaaatcttcttcggctattaatagtttcgaaacgggcatgatggggatggaacactggcaaggggcttggattagcgataacaaagatattaattaccgtcctgctccctatttccggaaagtgtttgatgcacgaaagaagatatggtcggcaagggcatatattgccgtagcaggtttgtatgaactgtatatcaatggtgagaagattggaaaccaccggctggacccgttatatacccggtttgacaggcgtaatttctacgttacttatgatattacttcccaaatacagaaagggaaaaatgcgattggtgtgttgctgggcaatggatggtataatcatcagtcaatggccgtgtgggactttcatcgtgcaccttggcgtaaccgtcctgctttctgtatggatgtgcggattacttatgaggatggttctgttgaagtcgtttctacggagcgggactggaaaacttcatccggcgcattgatctttaatagcatttatacagccgagcattacgacgcccgtttggaacagaaaggctggaataccgtgaactttgacgattctaaatggaatggagtaggatatagggctgttccttcacagaatgtggtgtcacaacaagtgcagccgattcgtgcagtagaaacaatccccgtaaaaatctggaagaaacttaatgatacaacgtatgtattcgattttgcccgcaatatggcaggagtcacccgcattaaagtgtccggggaagagggaactgtagtgagactgaaacatggtgagcggttgtatgacaacggacgagtgaatacgtcaaatattgatgtgtatcaccgcccggtagacaactccgatccttttcaaacggacatcctcgttttgagtggaaagggagaggatgaatttatggcacgattcaattataaaggtttcagatacgtggaagtaacaagcactaacccccttgtattgaatgagaataatctgacagcttactttgtgcatagtgatgttccgcagaaagggatgattcatacttcgaacgcacttatcaaccgtctttggtgggctacaaataatgcctatttgtccaacttgatggggtatcccaccgactgtccccagcgtgagaagaacggatggacaggcgacggtcattttgctattgaaacggcattatacaattatgacggtatcactgtttatgagaaatggcttgccgaccatagagatgagcaacagcctaatggtgtacttcccgatattatccctacaggaggctggggatatggtacggataatggactggattggacaagcactattgcccttattccatggaatatttatatgttttatggcgatcataaactgttggcagactgttatgaaaatataaagcgatatgtagactatgtggatcgcaccagtccgaccggattgacctcatggggaagaggagactgggtgcctgttaaatcacattcttccaaggaactgacctcttctgtctatttctatgtggacaccaaaatacttgccaatgccgcaaagatgtttaataaaacggaagactataaatattattctgctcttgccaataagataaagaacgcgattaatgacaagtttctgaatagagaaacgggcatttatggtagcggcgttcagacggaacagagcgttcctttgcaatggggcattgttcccgaagagttgaagagaaaagtagcccggaatctggcaaaacaggtggaagcagccggctttcatttggatgtaggtgtgttgggagcaaaagctatattgaatgcgttaagtgagaacggtgaagccgaaacggcttataaattagctgcacaagacacttatccatcatggggttgctggattgccaatggtgctaccacattactggagaactgggatttgaatgccacacgtgacatatcagacaatcacatgatgttcggagaaattggagggtggttttataaaggattgggtggaatcttccctgaccccgaaaatcccggattcaaacatattctccttcggcctaatttccccagtggattaaatgagctcgaagccagatatcaatcaccttatggggaaatctgctctaaatgggaacgtaaaaagaaccgtattgtctatcatgtaactgttccggcaaatagcactgctaccttttatgcacccgacaatgtgaaaggagagcgtgcagtaaatttggaagcaggaaaacatatcttggaattacctataaagagagctgtttattgaatgtctttcgattggtaatcctggttgctgtttacccagatgtaaaaaactgcttctacaccattgaaacggatgaatatatctctccccttccatgaatcgggcagagtgaaatccttccgatagctacctaccggattgggcatggaagcgaaagtataatctgccggacgaggctggatgacattgggccactgcactcctttgctataatcgcagaatggatagatcacgttacaatagagaggtttgtcccaatttcgtgcttttgtatagctgctttataactaatagatggagtgttttgaaataagaacttgacaaacgactttttattttgtatctttgtgatcagaaaagaaacttattgattggaaattatgtgtatgaatagtataatattagaacagagttgccgacgatttacctctctttagaagaagaggaaatttattatatactaaaggttgcagacttttgatgagtttgcaaccttttttgttgtataaaattgaattgtttgcagtagatatacttcttatcgtttttaataaataggaataccgtttattaaaaacgataagaaagtttattagaaacacaaaagtagattctgtatgaacagttgtcttttttcaataagatagaatagggataatgttgttccttctcattagaatgtcaagatggtaattagttgtaacataaagacctctgactaataatgtacaaatctacggattatgcttgcttcatatttatttcttcttaggttttctacgtgcccatccttcttcgctgaagtcaggttctttatctttaaaaaactcttgccagtcatctttctttttcggaccgcgagcatcagagtatcctcgctcagcacgactaggcttatctttttttgttgactttgagtcttttgcagaagcatctttcggttttctatccttattttcatagcgcggtgcacgttcgtcgcttttgccgccgaatcgtttacctcccttgcgctcatttgaaccgttttcacgtccttttccgttttcttcaccggcaccggcaatctcaacaactaccttgcgtccgttccatttagccctattcagcgccttgattacatttgtcgcttccttttccggcacttcaaagaaagaatagttctgcattaggtcaatacgtcccaactcgatacgtcctcttgtgttactatttagtagtccgataagatcgctagggaagaaactgtctgttttacccaaattgataaacaggcggttaaagcccggtgcagcttggcggcttcttttttcgaaaccaccttctttgcggtcaccccgtccggtacgttctcctctgatgtcagtcggtacttctatttctgcacggttgcgataatactcggcgaaacggttgaattcgtgagaaaccattcgtttaatcaggtcctctttgctcaaccattccagtttacgatagatttccggcataaagtcagcaatctcttcctcgtttacttttactttttcgagatcatcaataaccttaatcagctgcttctgacagattcctgctgctgttggcatttctccgacaatgaattttttgctgataatccgttcaatttctctcatctttcctttttcacggaggttgatgatggcaatggaagttcctgtttttccggcacgtcctgtacgtccgctgcgatgtgtataactctctgtatcgtctggtaatccgtaattgataacatgcgtcagatcgtctacatcaagtccgcgggcagccacgtcagttgccacgagcagttgcaagttgcggatgcggaatttctgcataacagcatcccgttgtgcttgagaaagctcaccatgcaaagaatcggcattgtagccttcttgcattaatttgtctgcaatttcctgagtctctttacgggtacggcagaaaatgataccgtatatttgtgggtagtaatcgacgatacgctttaaagcttcgtatttgtctttagcctgtacggtataaacaacgtgtttaacgttgttggtactttcattcttacggccaatagtgatttctttcgcattgcgcaggtaatttttggaaatgcgtgcgatttccggactcattgttgcggaaaacaatagagtgttgcgttcctgcggtacatcagccagaatggcgttgatgctttctgtgaaccccatattaagcatttcgtccgcttcatccattactacattgtggatggtagacaaggaaacggttttgcgttccatcaggtccaacaggcgtccgggtgtagctacaatgatgtgtactcctcgtttgaggctgcgtatctggctgtcaatagaagaaccaccatatacaggtaatacttttagtccgtcaatatatttggaatagtcattcaaatctcctgctatctggagacaaagctcgcgggtagggcagaggataagcgattgtggaattctgttttttacgtcaatctgttggagcaagggcaaaccgaatgcggctgttttacctgttcctgtctgtgcaagagctactacatcattattttctcctaaaaggtacggaatcacttcttcttgtaccggcatgggattctcgtatcccatttcttcaattgctctacgtatctccggagaaacgccaagctcttcaaatgtcttcattaaatctctgtatatcttttatttcggctgcaaagatagttaatttagttgataatgaatgattgatagtagataattattatagacgccaccctattttatcacttatcaactattaattatcagttaataagatgctgcgtaactgttcaatttcttctgcagaaagtccgattccctttttcagataggtctgtacgctcccgtattcagcctcaatctgttctttggcagcgttcaggaaatcttcttttgcagagtagatggttgtaatggcttcttgcgaattgaccgataacttatatgcatattgagaagctttgggaatattaaaatagtcattactcaaacgatagtcttccataatgacgtcttcgttgactccaagagcggcaagcaataaggcggaaacgacccctgtacgccctttcccggatgtacaatgaatcacaaccggataatgagtacggtcgagaaggacggtgaacagctttttgaattccttttggtagtttataactaattcccgattcatttgttctaccaaacgataaatagtgtcactttttatcttctcttcctgaattccttgcagaatttcttccatgttccctgtgagaatagggatatgtatgatattaaattcatcatcatgcaattgcgggtagttgtggcgttcattttcagaacgtaagtctatgattgtccgtatccccatattcttaagttcctggcgtgagcagggaggaatgctgtctatttgtgcggaacggtatatcattccccagcgaagagatttgccagtaccggcagattcatatcctcctaaatcacggaaattctgtatgccggggatattaatgttgcgggtagccactttgattcggtatttgttattaaataccatcaagtagtaatagcgttgggacggatcattggttacgatggtcattttaccactggaaatgttggttattgcaatgggagaattttccggaatagtttcaggagaagtggaagtgtatacttttacctgcccttttaatattggtgctgtttcccatttgataatacagtttcctacgttgttttcttcacataccacagatatagcaggtgatgtgccggaacatgatgggagcactaataaaacagtaagccagcttaacaggtttttatacatagtttctttgccttgaatcgtatactgcaaagataagaattacccgaagatgtggtaattcctttgcgataattagccaaagttaatagtaatttacgtgttaaaaaagggcacatcttctgatggaagagtgccctgaatgaaaaattgtataaatcagctttattagatgctgttcaataaatcagtttttccttcatttattaactttaaaattagttcgccgaacaaggtattttgccatgcaaaccaagcacgggtgaagttattgggatcatctttgtgaaaagattcatgcataaagcctgtccctgcgtctgtgttgattagcatttttacacactccttgatctcctggtcgtcctgactggtaaatgctttcatcatgatactcataggccataccatgtcatagccgatgtgaggaccaccaattccttctcctgcttttcctttgaagaaataaggattatccttgctccatacaaaacggcgtgtattctgatagataggatcgttaatatctacatcgccaagataaggcattgccaataaacttggtacattagcatcatccattaaaaaatgatttccgaaaccatctacctcaaaagcataaattgtaccatatttagggtgattgtaagttgcatatttttttagtgcagtctctacttcttttgccagatctgtacattgttttgccatttctgcattttgatttacagtattcagaatttcagcagctttctttaacgaagaaacagcaaagaaattagacggcacgagaaattgcaaggttgtagcatcgtcagatggacggaaggctgaaacaattagtccgacaggattcacaggagcacctaaaccgttgttgtttaatgtatcgagtgcacgttccgttttgcgttgaaatttataaggtcctactccctccttacgttgttgctccttaaaagtagacaggatgttggtgatggcttgtatccattcactatcaaaaatactggcatcaccggtctctttccaatattggtaggccagacgtagtgggtaacatagagaatctatttcccattttctttcatgtaattcaggtttcatgtcggtcaggtcggacatccattctcctcccacagctccgtcattgaaagcattggcgtacggatcaatattaatacatttaaattgtctgcggatcactccttcgagcattttcttcaattccggatctttactggccagttgtatataaggccaaacctgtgctccggagtcacgtagccacatggcatgaatatcacctgtataaacaaaagtatcaggtttgccatttgttgtgcgataatggactgtcgtttcgagggtatttggaaaacaattctcgaacatccatgccaatttttgattagtaagtaactttttcaccctgatgatttctgcttccacggcttttgatgtaaaaagacgcttgtttacgggtggacgattacttttataagcggcaatttcagctgcttgattaaccacattggtatgatccttagctaggataagttctgtagctttagcatggcctcccattaatagggtagttgtgataatgcatattccgatgtttcttttcttcatatctctattgttttaatagggttattaaaagtgattattgcaaatcgattccgcctagtcttccatacatttctatgaaagcagcttgtgtcaagagccattttttctcgtttttatccgtgccactccaatctgtatggaacagtccccgttcatctctggcatgatgccatgcgtaatcaagacttttctggaaatcggttagataggtcttgttatggtctatttgataaagttcaataaagcctctaagcataactgctgtgaaccagatatttccttttttcagtaattgaaatgtttgcccgtttggagaggtaaaatgagtgaaaaagtgtttatgacatgcttctgctatattttgagcatcttccagataatttctctgttttgtaatttggtagagtagggcagctgcttgcatcatttgcccgctgttgtaggcaaatttggcacgaccgattttcttattgagtgcgatgttgtcaaagtatagatgatcctttggatcttccaggttctttttagtccactcgtataagtcttttccttgttttaaataggcgtcatcttgagtagcctgaaatagcttgagagcgaatacggctcccggcgcattagaacaagtatttttagattccttcttttgttcgcaccagtagattcctccgccaagtacgtcatctttaccactaaggataaacttccatattagtttagctttctccagataagcttgttttcctgtcatacgataagaatcggtaaaatcgatacctaaccagacgttgtcatcataaaaacgatcggagagaggttgactgctgatataagatgagtaagcgaatggttctcttcgtgtgtcgaagtattcttccaatcctggtagtactttgttttccagaagttttttatacttcttatttccagtgctctccagtaatgcatttactgcagagaatgtgcccgaatacggccaaaggtaggaatattcattgcgtctttttgcttgttcttctgatgccagataagttgccttattgtcttggttaaaaggatagttctcacgtaacagacacgtgttgggtgctgcatagttttggtaaagagaatctagggtctgctgtgctctttctacgtcgggactggcattcgataaagttaatgcacaaataatattcactaataagtaatgcatgattttattattttataaatgattattgcataaaaatatttacttgcttccacttgtcttcagtatcattcgctacttctgttcctggtgtggaacgtccttcctttacatactttctgatgagtcgtgtcatttcttttacttcctgtttatagcgtttatcatggataatattttctttctctgatgggtctttttcaagatcaaatagctgcattggaggtagttgggccaaatcagcaggcttattggggtatccccatccgcctgaacctccattaaaaactagtttaagttgtggtgtgcgtagagacaaatatcctttccctgattcataaataaggtcctttcgggtagaagtcccttctttacttaatataggccacatactgtaactatctacagcctcttcagtttttagtttatgattgaccatttgtgcaaaggtcgcatagaaatcggtaagagaaacaagggaattacttattttattcgagaacttccctttccaagatactattagaggaattctgtgtcctccttcgtaaatatctgttttatatcctctgtaaatataactgggaaaatgaccttgcttttccatttcttttacgccgatataaggagcacagccattatcagaagtaaaaataatgatagtattatccaattggttatttttcttcaatgtttccacgatttgttgtaccatatcatctatcatgactacaaaatctccgtaggctcctattgttgttttacctttatatttgtctgacggcaacactggtgtgtgtggtgctgtaataggcaaatataggaagaatggttttttactgttacgctgtttgtcaatatagtctatactatgacgtattatgtttggtagacaatcctgtggatcaaagccggctcctgccactcctccgtgcattaaaccgagtcccttctgcggttcaatgatatggtcgggaagagcagttactttattgttttctacataaacataaggagctatgtcaagagaagaaggtataccataaaaatagtcgaatcctcggtctgtgggaccattttttataggtaatgaaaagtctacatctttcttatttttcgcattttgaggatatccccaatcccagcctaaatgccattttccaatacaggcggtattgtagccattttcagaaaacatttgggcgattgtccgacggtcgggtgtaatcatagcaggcgagtaaccgtcgagtacaccttcttttaattttgttcgccaagggtatcttccggtgagaatggaatatcgtgacggtgttgacaaggcggaagaggagtgggcatctgtaaaagtaatcccatcttgagttagattatcaatgttaggagtaggaatcttagattctggattgaacgctgagatgtctccatatcctaaatcgtccgccaatataaatattacattgggagattgtgctcttacggctgctgtcgcaagtaatgcggatgaaagggtgattagtttatgcatgtttttttaatatgagtgtaatatttgctctagacttatgtttttaggggtttgtaataaaggaaattctggtagtatacacatgggtattgcaggatctcctactttccaagctggtatatttgcaaagagtctttctagttttcttcttgatttttcagcttcggcatttcctttaccctttgcaataggattcgtttctttaggatcttttattgtatcgtaaaaattaccatcggaatagagcttatatcgcatgtctctaaaaaattgttttgcatttttactcgcggacgcgttaaatcttgaatcataatgacagaatacccattcgcgagacttacctttttctccctttatttgaggtaaaaagctttgtccatctatatcccattgtttaggcactttaatattcatagcttctgcaaaagtaggcataaaatcggtgaaatctatcatatctgcacattcatgctttgtattgttattttttccccaataaactatcataggtacacgtactccagtatcaattgttagccccttcccaccccttactattgttccatctttcatggttgttcttatgttacggtttgttccgttatctccaataaaaatgataatggtattgttcaataagtttaaattttctaacttgttgaatatcatgtttatgtttttatccacatgttctaccatctttgtgaaattggcggtattgcgtacttcacgcatggagggatctttccatacatcactttgaggagtggggtaaaatggattatgcactaataccataggataatatatgaaaaagggcttagttttgttctcttcaataaaatcaatcacatattgagtgaatatatccggtccatattcattgtttgagtaaagctttatatttccatcttgttctattagtggagcggcatatctttcttttatcatcctgtcatagcttaactgccaaaggcaatagtgatcgaaaccaaaatgattaggcagatttctgtttctgcctaattgccatttgccagctatcatagtggtatatccggcgtcctttgctaaatgggcaaaggttttctccttttgatttaagtgcccaaagcaggagtaatttttattattgtatttacctgtcattagttgtacgcgcgatggtgtgcttaagggttgagagaaacagttgtcgaatctcactcctatttctgaaagtttgtcaaggtttggtgtttgataggtactgccataacatcctaaacattcacgtcccatatcatcagctaagatcaacacaatattaggctgtttgttagctgtttgggccatcaaaacggagggaattatagcgagacattcccataagaagctattaatgactttcatttgttgatagttttagatgtttatattctaacttctaggttttgtttattgcatgaatatttcgatttgcttccagctattaccagtatcattcgcactcctctttcctggggtagaacgtccttcttccacatactttttgatcatctgtgtcattttatccacatcttttttgtagcgtttgttactgatgatattcttcttctccgaagggtcttctttaaggttaaagagttgcatgctgggtagtttggctagatcagcaggtttattagggtatccccatcctcctgaaccaccgtggaatactaattttagctgaggcgtacgtagagatagataaccttttcccgattcatagataagatcttttcgggcagaatttccttttttgcttagtataggccatatactataactgtccaccgcttcttcatctttcaattggtagttcaccatttgggcaaaggtggcatagaagtcggtgagtgataccaatgaactgttggtttcgttcgtatattttccttgccaggaaacgatgagtggaatacggtgcccaccttcataaatgtcgtttttataacctctgtagatgtaacttgggtgatgccctttattttccatttcttctacacctatgtatggagcgcatccgttatctgaagtgaaaataatgatggtattctctagttgattgtttttcttcaatgtttctacgatttgctgtaccatgtcgtctatcataactacgaaatctccataatctcctatgattgtctgaccttgatatttttttgccggcaatacgggagtatgcggtgctgtgataggaagatataggaagaacggctttttactgtcacgctgtttattaatgtagtctataccatgacgtataatattgggtaggcagtcttgtggctcaaaatcggcacctgcgactccattacgtatcagtttgattcccttttgcggaccaatggtgcgattgggaagagctgtcactttatcgttttctacataaacgtgtggagctgttccgagtgaagcaggtatgccgtaaaaataatcgaatcctctgtccgtaggaccattcttgatagggagtgagaaatccacatcctgtttgtttttggcattttgaggatatgcccaatcccagccaagatgccattttccgatacaagcagtgttgtagccgttctcagaaaacatttgggcgattgtacggcggtcgggagtaatcatggctggagagaatccattcaatactccacttttcatagttgttctccaaggataccttccagtgataatggaatagcgtgaaggagtagagagcgcggaagatgaatgggcatccgtaaaggaaattccggagtgtgtcaaattatcaatgtttggggtgtggattttggattccggattgaatgctgaaatatctccatagcctaaatcgtctgctaatatgaatatcacattgggcgattgtgcctttacggcagttgctgtaaggagtacagatgagattgttattagtttgttcatcacctttgttaaatcttttgtgagttttattttcttttcaatcggtcaacgtgagctcaatgaactttcagaatgatacaatatgaaaaatcattgagctcacgtttgctatttattcttgtactatgacatttataggacaagtgaatccattttcaaattttgggtatgccgtacccgaattaggcagtgactcgaatatgaaagtgaatgttcccgctttattcaataaggtacctgcatccgcattgaaatcgacatacgatatgaaatacttttcatttagttttgaatcttcaaagaaatgaacgatctcgttacttttcttgttggctgttccagctccaattttggacttgtcaccggctacctttacaacatctggtgtgtagaatcctctgaaccaattgtttttgttatcatcatgtgctttgaagttataacctgttggtactgtagccccttctgatttgtatgttgcaaaccaaatgcgcatagcagtattacctccaagtgcctcccctttggtcagtattttcgtttgctggttacttttctgtaccaattcgcctcgtattgcttttacgggattgctttctgtaggttcccaatcttcattgaaagtcggtacatcaggagtatcggtagtaaggttggggttgactataaatccggatactggattttctgtaattgtaaattcaaagggtacccatcctgtttctcctgtgacaggatgtttgggaaaatactgtatgatgtcattaccggcatctgtatttgtatacttgatgtatatcttatagttacctggtttttcgatataagatttgggcgttgaagcactgatagtccaagatgcggatgacatgggacgtgtgcggtttccgccatagagtatatcaggagtgttttcgtcccacatgcctacagatattggttttgaatttgttccatgaaagaatatatcattttctccccaaacgtgacttagagtaccgtcttttaatgtaaaagcctcggggtattgttccatattttctggggtgggagtaaataaggtaagcgcttttacaccattatcttcggtaaagctgggacgaatggcattattggcaatcataatggaattgtaacgtagattagcaacgcagttgtatgtaagtcctgcagttttgatttctgtggagggactggacattcgggcataccaaaatatttgttcgttttgtgctccggttattggagcagattgatttacccagttaatttctccaccaagaagaacaaaaggtttttcactggtaggaatgaattcgcgtgcaggacgttgagtgccctcagcccaaatcggaatcgttttagtgatggtagtaccaattttttctccattttcaaaaatgtcaaatgagatgggtaccgatccgtcttgtgttggggttccgcttatcgggaaataagcatattgtttgtctccctgaaaggagagttgtacttctccgtcttctattttcaatccggtttcggatgaccggtcaacaaacttgacgagtagtttccggccaaaaccattgacgaacggaatccccaagcggtcaccgggttcattttcatcaccggcaaaagcgggagtacctttagcaaggaatccatctacataaatggttgattcttgtacgttcaaccctttttcttgtataatatattccattccggggtgttcgcaggaacagaacagacctgaaataaacaatatggatagtaatgtggtaatcttattcataatcatgtttcctttcgtttatataacatttgtcatcttgcaccataattctgtgtcagtttgggattggaacgtatttcctgtgacggaattgggaataaggtacagtattgatcaatctcaaatttttcactcttcatatagtagttgtttacattaggagaactgttggaagtataggcattatagaaattggtgaagtgttggttcatcacttctacagcttttcctgaacgaacgaggtcaaaccagcggtgcccttcgaaagccaactccaatgttcgttcgtcatagattgcctgataaactttttctggagtatctaagacccattctttattagggtctccagacgcaagatacggaacaatgccggctctttcccgtacaaggttgattgttttatttaaaacgctttgtgacaggatcccgtcactgatatgcgcttctgcttctgccaataacagcagtatgtctgcaaaacggaggatataccaattgtcatcagaatcatttactttatactctgatgagctcatgtatttgccgcacatccactggttatctgcattaaagccttttacagaagcccggaaagaggtaccggtataagggtcgtaaggatatgcaacgtcttgcggataatctttgttctcattaaccgggagataagaaatgccgtccgtatctaatttgatattaccgttgctaatgcgtgtatcggtgtagataatatcatcaaattttcgtacttcatattgataatcgggatacatagaatcccatttttttgccatatccataaaatatccggtcggtgagcatgcaccgtttccttgatttgaaatgggagacgggatatatccgtttgaattggctttattacgaggtgcataagaagcaggtgagaaaagagtatagaacggacttcccaatccttccacttgaccggttttgtattccacttcccatatggactcgcatgaatgtttgttggtggatttgaacaattcgctgaaattcggatataattcatatcctccattgtttatcacatcttccagataatacttggcagcttcatattgcgtagtagttgttttcggataaaatacggtaatattcggattaatggatatatctttccatgtttctacatcggggtaagcggcttccgtgatgtcgtttggcatagataggagtacttttcccagtaaggcttctgccacatatttgtcaactcttcctgtcggagttttttctccgctgtttgtcgatctatagaggttgttcgattcgatggcagaagtcagatcggtgagaatccgtatatagacctcttctgcagatgcacgcagatgacctctggaatcggtgtattcttgtggaatatccatgatgatgggtactccaccgtaagcgcgaactaagttgaaatagaaaagggcacgtagtacttcggcctctgcaatgtatttttgaacggtttcatcattcccgaagagttctttccctttttcgatgactgtattggctcttatgattcctttgtagtgatgagcccaatagttttggtttccactattgttggcagatatggtaaatttttcaatttcatgtcggaaagtattggcatagtaattagtttgatttggaaatgcaacatccgaacgcacatcaccgaaaagatagatgctggccgaatacagcccgttatctctcaatgaagagtaagttgagtacaatgccgaacgtatatcatcaggtgacttgtagaaatttttacccgttaaagtggtttccggctcgatatctagaaaaccggtacaaccggacatgcaggtggcgatcaatgccactgtaaatatattcttcagattcttcatattctttttcatgctttagatttataatgtagctttcagccctatggtgaaatttctagataaaggatatccggtacggtcgatgcccggtgcggtagccgaacggaatgtgttggcttcagggttcataccggtatatttagtgaaagtatgcaagttgtcaatattgaaacttagtactaatccgttcagaaaggtttttcggagcattttcttgtcgaatgtgtatgaaagctggatgttacggatggacagataagaaccgtcttcgagatatcggttggtaaatttactcatttccgtggttggacgtacatcattggaggtgtaagtacggtctgctaagccgttacccggcgattcgggcgaacgccatctatctactactttgatggaaaggttgttattgttgtttccgcgcagtgtctcacgtaatgtatagttgtaaatctgatttccgtattgtccgttcaactgaaaactaaatgaaaagtttctgtatgagaatgtgttgaccataccggcattgaaacgtgggtaaggatttcctataatagtacggtcattgtcatcataaagtccgtcaccgttgagatcgtaccatttacagtctcccggccgaacgttcgggtcgaaagccagtcctgaataagggtcattccgcaatgcttgaatttcttccattgactgataaatgccgccgaatacatttccgtagaacatacctatcggatagcctactttagtgatgtttgattctgccactccatcagtgatggcttcagaatcgagtcctagtgccaatactttgttccggttggcggagatgttgaacgtagttgtccatttgaatttgccggtcaggttgcgggatacaatattgaactcgatacctttgttttcaacggaaccgacgttttgtaacatgcgtgaaactcctaaagtgcttggaacgattgtattcagaagcatatcggaagtgatagacttgtacaaatcaagttgcatgaatattcggttgtggaaaagtcctatgtctacacctaaattagtctgtttggacacttcccatttcaagtccggattcgcaatgtttgacggagcccaaccacttacgacagaaccatcgactatatacgattgctgtgacattttggtctcatagttgtagtctccgatagcattgttgccagacagaccaaaactacctcgtaatttcagttcactaagtactttcttgagtggcttcatgaatttttcttccgtcatggcccatcctgcggaaatggaggggaaataaccgtatttgttgttctttccaaaacgacttgaaccatctgcacgaaatactccctgaatcatatattttcttttgtagtcgtaggtcagtcgggctatataggatagcatacgatcttcagtcttatcataagaacctccgttgactacacctccgttgatggaagggagagattctgttgcaaaatggtaggcggacgtgtaaagcttgttgagttggttactttgtatagtgacacctcctacagcactgatgttatgatctccgaattctttctgataggtcagtatattttcgttaatccacatgagtttgcgagtcatagtggtggaagcctcagagtcggtacggtttttgccaatggaagctgggtaccatattgagttctcggatgacatgaaatcaatggccaatgacggtttaaacgttaaccctttagccaatttcaattcgaagttaagcccaccgataatacgattctgactcgtctcgtttttgtattcgtgagcgattctgactggattgtcttgattgtcggccaatggcgaatcggaaagcgttgggaaggcaccggtttcggggtctcttgaatcggctatgttagttggggccaagttgtactctaatgtagagaaataatctccattaggaagtttgaccgggaaaaagggatacatggagattgcagttcggattacgctgtttgatccttctccaccttctcttgttcttttctgattgataaatgtaggagcaaagttgacagttacttttgcccacttatttaattcgatgtcgaagttggaacggaaagcgaatcgcttcattccggtacatatcaggatcccttcttggtcgaaatattcgcctgagattcggtaacgcatatttttacctcctccagcgatagacagattgtatttctgctgaatggcattctggaagatggcatcttgccagtcagtgttgagattctcgtcgaaagggaaatagtcttgattttggtttgtcgtgtaacgaaatctttcgttcagattcttatccttataatattccaataattgggctgtattcattaattcgaatttatgttgtatttgtgctatggtggttgaagcattgatggttactgtcggtttggtactttcaccgcgcttggtagtgataagtattacaccattggcaccacgtgagccatatacggcagttgaagcggcatctttcagaatctgaatattggctacgtcatcaggattgacagcagacaggccgccttccatcggtattccgtcgacaatatataaaggttccgagcctgcagtaacggtaccgataccgcggacttctacattgatatcaccaccaggagtcgcgtcggaagtctgtatacgaactccggggactaaacctgagatggtttgttcgatagaagagcctacatatccagataattcttcggatttgatggaagtcatggcagatgttatcgttctctttgtttgggttccatagccgataactacggtttcatccaacatatagccatcttcaatcatgactactttaataagctttttggggtctttgattgtgatctcctgtttctgaaacccgatgaacgaaaattcaagaactggattcttaccttttgtttgaatcttgaaagttccatcgatagtggtggttgttccataattggagttttggcaaaggacattcacacctggtatgggttgtccttgctcgtcaacaacggttcctgttgcaaatgttcgggcattctgtgcgtatgtatttccacctgtatatgaagaaacttcaaatatggaaaatacaatagttaaaaagagaatgcggatagaaatcatatttctcatatagtagtaaatttagttatgccacaaaaatacaatcaatatgtatatctcctatggtatgtaaaagctaaaaggagaatttgtaaaagagataatatttaacttgcttattagtagtatgttatctaaaatatttgatgataaaatgtaatgactatgtgaattgtttaatgctgatggatgtactgaatataagatggtagtgcttttttcttttcctttttgtagctacataattgctatttaattatattttatgttgctgattattagcatgataccttttaagctacttatatttttcatcaaaataaaatctaggaggtttcaatggaatgagcatttcgtatatttgcatgaaataaaagtatttgttttcctttcaacaaccaaattcgcataaaattatgaagaatcactcgagacatttcgtagccgctacttgtgctttagcagcattttctcccgttgaaatgatggcccaaaaacaaccaaactttgtcattatcgttgcagatgatatggggtatggtgatgtgggcatatacggcaatgagtatataaagaccccgaatattgatcaaatggcccgggaggggatgatgttcacagatttccattcgaatggttcagtcagtagtccgacgcgttgtgggcttttaactgggcgttatcaacagagagctggcttggagaaagttcttttggtaccccgagatgataaagataaggaggtaggacttcagtcggaagaaataacttttgcaaaaatcttgggagacaatggataccggacagctttgattggtaaatggcatttaggatacttgcagaaacatcatccgatgaactttggctttcagaaatttgtaggttttaaatccggaaatgtcgactatcagagtcaccgcaaccgttatggagatgtggactggtgggacggtttggaaatgaaaaatatgccgggatatacaacaaccttactaacaacgctttccgaggattacataaaagaaaataaggataaaccattttgtctatatatagcgcatgcggctcctcactctcctatgcagggacctaatgaaaaggcgatccgtacagaggctactctggaaggggataaaaactccgacaggccaaataaggaaatttataaagatatggtagaggaattggattggagtgtgggacggattctggaaacgttgaaaaaatataaattggacaagaatacgttcgttgtctttttctctgataatggtccggtgataaataatggaggttctaccggagggtatagaggtgcgaagggagctccatgggaaggaggacaccgtgtccctggtatttgttatatgcctggaactgtcaaaggaggaacaatgtgcaaacagaccgtgatgagtttcgatctttttccgactatgctggacatggcgaacattcattatgatgactcgaagaagaagttggatggagcttctctggtacctttgtttaaggggaaggagctttctcagagacttttgttttggggaaatggtaataagactatctctgtgagagatggcaaatggaagctggttcgttacaaccaaaagggaaaaattacattgcatttgtttgacctggacaatgatccatacgaggaaaataatatgagtgagcaggaacctgaattagttaaaagactggatgaacagattactcgctgggccaagtccgtctattcagaagttcctgaccagtttgctcgaaaagtacgacgtacgaataaaaataacacttaatatgcatagtaactatgaagatagaaaaaatagccttgctggcattgggaactactatgacttccggtgcagctttggcttcgaatacggttgataaagctactcccaatgttttactgattcttgtagatgatcttggattgggcgatttgtcctgccaatatgctaaagatttgagtactccaaatattgatcgcatctttgaaactggagtgcgtttggataacttttatgctaattcatccgtgtcttctccttcgcgtgccgcactgttgaccggacgttttccggctatggtaggagtaccaggggtcatccgtccttccatcgatcaaaattggggttatttcgatccgtctgccgtcaccatgcctgaggtacttaaaaatggtggctacagaactgcactaattggcaaatggcatctaggctggaaaagtccgaatcttccgaatgagagaggattcgagcattttcatggtttccttgcagatatgatggatgactattacacgcatcagcggcagggaggaaattacatgtatctgaacgacaaagaaattacccccaaaggtcatgctaccgaattgtttacttcatggagtgtggattatattaagaaagaggcaaaagagaagaatcccttttttctttatcttgcctacaatgccccccattctcctttacaaccaccggtagagtgggtgaacaaggtacaggaaagagacaagtcgttaccggtcaagcgtgcacggctgatagccctgattgaacatttggatgataatataggtaaagtgatgcaggctctcgaggaaagcggtcagttgagtaatacattggtaatatttgcttctgataatggaggggaccggggaagtatggcaaacaatggacctacccggggtgccaaaggcgatatgtttgagggaggtatccatgtcccttgtgctctgaatatgccaggagttttcgaaggcggtcgacgtgacaaccattttgttgtgatgatggaccttatgcctactatttgtgattttgtgaatgtaccggtcaggcatgagatagatggtatttctgtattggatgccattaagagaaagaaacagaatacagaagatcgtttcgttttctggcttcgaaatgaaggtggtccgcaatttggggggaagtcgcagagtgcggtgaggtataatgagtacaaacttttacagaatcttccctttgaaaaagtacagatgtttaatttggaggaagactctttggaaactactccactacctttgcaaggagatatgtttcgaaaattgaacaatgcaatgactaagcattatcgtgcttggggagcagtcccttgccaagcaccatctaaatagaaacttaaatcataaaataaaactagtatgatgaattttaaaatgaaaaacaagaccctattcctatgccttccggcaatgttgaacataccttttggaggctcttctgcattcggagcgaattcagaaaaagacaataaagagaatagcccgaaacgccccaatgtacttgtattgctaacggatgaccagacattcagcactatccatgcttggggtaataatgaaattcagactccgaatatggacagacttgtcaatcagggtatgtcattcacccaaactcatgtaatgggtggactcaacggtgccatctcgcagcccagtcgtgcgatgcttcttaccggacgcggtctgatggacgtacaccgcaacggacaagtcatccccaaaaatgagaaaacatttcccgagctgttccgcgagaacggctatacaaccttcggaaccggcaaatggcacagtgacaaagctgcattcaaccgttcgttctctacgggtgcgaacatttttttcggaggaatgcatccctatggaaatgaaaaggaagaaaagggacaccgatgcccttatctgcatgagtacgacccgacagggaaatacaaaaatggtcaatgggtaaacgcatcactcaatactttctcgtctgagttgtatgccgatgccgccatcaagttcattgaaacaaatgcatcgaacgataacccgtttctgatgtatgtcgcatttacttcgccgcacgacccgcgtaatgtgttacctgattacgggcgcaaatatgatagcaaggaaattacgatgccaaagaattttattacacagcatccgtttgataacggtgatctcaatgaacgcgatgaaaaactgttgcctactccgcgtgtaccggaacaggtacttgccgaaagagccaactattacagcatggtgaacgaggtagatgttcagatagggcgtatccttgatatgcttgaaaaaagcggcaaggacgataacaccattatcgtatttgcagcagacaacggcctttgtgtcggagaacacggactgctgggtaagcagaatctgtatgaagcggcggtgagagtacctttggtgatatgcggacctaatatcccgaaaaatatgatgagtgatgcctattgttatctgtacgacctttatcccaccctctgcgatttatcgaatataaaggtaccgaccactgttaagggaatctcattggcgcaaaccatacaggatccaaatgtgaaaaagcgcaaggatatactattaacatacatcaaccttcaacgagctatcaagaaggatggcttcaaacttatactttataatgtagacggtcagcgtcatccgcagcttttcgaccttaaggccgacccaatggaaatgaataatctttatgataatcctaagtatggtaagaaacgtgaagagcttactaaattactttatgcccgaatggcatctgtcggtgatttctgtgaccccactaaacctgattggggctatccgacgaaactgaaatgggaacagattgtcaaagtcaatccttgatgtaggcagatgtgtgtaaagggctttttagcaccaatatgagaaaatattattcccactgtaatgagagaaaacagcttattatagtgggtgtttttttatcatggtgagagtagccttttattgcccgatacgtcccactctttcttcgaaagagttacggtcgccaatagctttgtttctcattttcgagcggtaattgtaaatggtagacagcgaatattgcaagaaatgggctatttttacactgtccgtgattcctaaccgaattagtgcgaagattcttaattcgggagttagcagtttgccagtgccgggtattatggcattttctggtgataagagtgcattaaagtctgctacgaagtttgggaataagttgaggattgctttgtcgaaattattataaaactctgccaagtctccttctgtatttagcgaagacttgaggaaagaaactactttattgatatcttcactctttgctattttaagggctcttttcttgaaactgtctatctgagtgatatagttggtatattgctccatatataatcccacatattcttccttaattttactgctatcagccagtgctgagtttatgttttgtatttcatccaaatgatatgacaggcttttattggcttgttccacttttttcttttgcttctttagttgggtgaaaagtataaataataggatacagacaaggcacagcgaactaagtaggctactaataataacaaatttgcgtttttctttctcttgaaaagccttgtcgatgaagaggtacatatccgaggcttcgattgtattgattctggcattacataagatggcatcttccattgcatttttcatgtatgcgtatgcccgatctatgtctccactctcaaaaataagttttgccaatattcgcaaagaacggttctctctagttccgcttattgcatcggatatggcagatatggcaaagtacttgattgcattcttagagtcacctttgccttgataggcggaggctaatgaataagctaatataccggcattccgcgaatattggggatagcttaaataagcgctgtcaagcatatggatggcatcattatatttctttttgtgtagcaggataggagcaattgtgaaagcccgtatattggaagggacttctgcgcattggagtaaggagtcgcgataagtttgttctatcaaatcattcttgcgtgattctatttcactggaagcaaaattcttctggtgattgtagatagtggcttgcccgaggaagtattccactttaagtttgggagacaataattgatgttgtatgggattgacgatggacaatgcctctttgaaaaatcccatggaagataaaatacgtgcatagtctagcttggcttctatgataagctctccatctccactttcttgagccaactcattcatatgaatagcataggttaaagcggaatctttttgaaaggaagaataggcgaaacataataattcggctatttgtacttttttgcgtattttatggtgtaacttcagttctattttcagactatctatttgctcttgcttttgttctgcataatctaacttatactttagggctttatctaatgtttttagtaatgaattgatttcatcgttagctgtagccggattgataaaaataatgcagagtaatacaggtaaaatgaactttctcatgattatattagattttatcgctaaagttgaatttgggataaaggtaaatataatatttgataaatgctagcttgtgatttaattctcatgtttgagatttataattccataccgaaccgtaaaagtaaatatcggtttgatatggaatctttttcagaaatgcctatataaaattaggaaataattgttatttgtatttttgtgcaaactccaccgataccgaattactgaaacttcggcaaacttcagctgcgaagtcttttccgcattggattattttatcccagatctcttcattcaagttatttagatcgcggtatcggacatcgtatttgagtaatccgtagatcagccctgcattgaagttatcaccagctccaatagtactgactgcttgtaatggttctatcggataatctttattgaccagattagtgcgtaacgctaccttttccgcacctgcagtacagatgaaccggggacagtagaatttgattttatccttgtaaatcttgtctatatcctgcatgttatacatatatagaaaatcctctaaagaaccgcgtacaatatccgcatattccagattttcaataatggtcggagccagtttcatggcttcattcttgtgtgaagaacggaaattcgggtcataatagatgatggctttcttttcacgtgcctgatctagtaattcgagaatcttctccctcagaaccggattcagtgcgtaataagaacccaccatgacaatgtcgtcttcctctagtttcggaaacagaacatccagacgttgcttcgggtagtctttgtagaagatatattcagcatcactctgctcgttcaggaaagctaaagatacgggtgattttccatccgggaatacatttacatgatcggttgggatatgattctcacgcatgaactgcaggataatattgcctacacggtcattcccggtttcactgatgaagccgacgtttattcccattcgtcccaatgagacaataccgttgaatacagaacctcccggtacggcggcagaaggctggtcacctcgaaagatgatatcgaggatggtctctccgataccgattacttttcgcatagtgatcttgatttttctcccagataaccgccgtggtgacgttttgaatattcagcgatagtaaatcctgtttccttcatggtttgtactaccaatatatctccaatcactgtcatggcagtagtggatgtagtaggagtcattcctaatacacagacttctgcaggcttaccggtacttaggcagacatccgattcttttgccagcggactatccggatttccggtgataacgataaacttcagatccgggtccagattatgggctaagcgggttaattccacaatctcacgtgtcttgccagagttagagatcagcaggagtagatcgtttttttgtaagatacccaaatctccgtgttgcgcctcgctgggatgcagaaagacggatggaataccggtggaacagaaagtagtagcaatgttcatagcaatctgcccggcttttcccataccggaagttaccagttttccctttttctgatgtatttgttctacaatcagtttcaccgctttttcataagcgtctgttacggggatgttgagcacagcttgtgcttcctgttgcaaaagttgtttgatggagtctatcatataggatcagtttattttttcttttaattcatttaatgtgtttgctacttcgtaataggttgagaaaggctgtcgtgcaaaacctttgtcctccagggtgtggagcgcttttaatagctcgtcgtaaaaaccatgttcattgtagaaaatgaccttcttttggtgatatccgatagaggcagcggctattacgtggaaaatctcatcaagagtaccgacgcctccggggagtgcaaccaatacctccgacttctccgttatgatatctttgcggtcactcaagttacgggtatgaatttcttcatctaacagagtgcttaccttgccattctcttccagtttggcaggaactactccaataaccttaccaccattttctttcacggcacgagctatgcattccattaatccgaggctggctcctccatatatcaaggttttgcctgtctgccccatccatttgcctatttggctggcgctttcgaagtacattttgtcaatgttatcggaggcggaacagaatattcctatcttttccatatacgttgttgctgttatagtccacaaatatctgcaattttctataaacagcaataagttttattgtatttttgtggcattaattcaataaggaagtataaaacgatgcaaggtaacgaatatacattgccaaatggcctgcgtattatccatgaaccaaccctctcaaaagtagcttattgtggttttgcgattgatgccggaacccgtgatgaggcggagaatgagcagggaatggcccattttgtagaacatctgatttttaagggaacggagaagcggaaagcctggcatatcctcaaccggatggagaatgtaggtggtgacctgaatgcttacacaaataaggaagaaactgttgtctatgccgctttcctgaaagaacatctggaacgtgcgcttgagttgttgggggatattgtatttcattcaacctttccgcagcatgagatagaaaaagaaacggaggtcattatcgatgaaatccagtcgtatgaagatactccgtcggaactgatatttgacgattttgaagacatgatcttccgcaatcatccactgggaagaaacattcttggtaagccggaacttctgcggagttttcgcacggaagatgttctatcgtttacccgccgtttttaccaaccgggaaatatggtgttttttgttcaggggcaatacgagttcaagagaatcatccgtctggtagaaaaatacctgttggatattcctgatgtgaaggtagagaatcgccgtacacctccgcctctgtatgtgccggaacatttgacagtggccagagatacacatcaggcgcatgttatgatcggtagccgtggctataatgcgtatgatgacaaacgtactgcactctatctgctgaataatgtccttggaggtcccggaatgaatagtaaactgaatgtgtcccttcgcgaacgcagaggattggtctataatgtcgaatccaatctgacttcctatacggatacgggagctttctgtatttatttcgggacggatgtggatgacatggatacttgcctgaaattgacctataaggaattgaagcggatgcgtgatacaaagatgactacctcccagttggcggcagcgaaaaagcagttgatcgggcaaatcggagtagcgtccgataactttgagaataatgcgttagggatggcgaaaacattccttcattatcataagcatgaatcatccgagcttgtttttaagcgtatagaagagctaacagcagagatgttgttggaagttgccaatgagatgtttgcagaggaatatttatccacattgatttataaataattgattgacagatttgctttcattgccagaattcgtatttttgtagcagatacgtatgtgataacaatctaatagtagaaattgtatgttggtgacgggcagaaaactccctatcgggattcagactttcgaagatatccgcaatgacggatacttgtatgtagataagaccgcattgatgtggactatagcaaacatcggtaaacctttttttttaagccgtccgcgccgattcggaaagagtttgttaatttctacgtttgaagcctatttcaagggacggcgtgaccttttcacgggacttgtcgtggaacaattagaaaagaagtgggaagaatatcccgtactgcatctggatttgaatgccgagaaatatgattcaccggacagattggatgctattttaagtaaccagttaactcaatgggaagctatatatggcaggggagaagatgaaaccactttgtcttcccgcttcttgggtgtcattcgtcgtgcctccgaacaagcaggcaggggtgttgtagtcctggtggatgagtatgataagcccttactacaggctattcagaatgaaccgcttctcgattcttaccgttctactttgaaagctttctacggtgtgttgaagagtgcagaccgctatcttcgttttgcttttctgacaggtgtcaccaaattctcgcaagtaagtgtgtttagtgatctgaaccaattgaatgacatcagtctgaattatgacttctctactctttgtggaatcacccgcgaagaacttcttgctaattttgaaccggagattgcagctttatcgcaagcaaatgacatcaatacgaaagaagttgtggaaacaatgacccggcagtatgacggttatcattttcatcctaatggagaaggagtgttcaatccattcagtgttctgaatgcatttttcagtaaagagttcggtaattactggtttcagaccggaactcctactttccttgtggagttattgaaagagagcgattatgatcttcgcttgctgatggatggtatagagacagctgcttccgctttcactgaatatcgtgctgataggaaaaatcctattccgttgatttatcaaagtggttatttaaccattaaagactatgataagcgttttaaaatgtatcgtcttggttttcctaacgacgaagtgcgttatggttttcttaactttctactaccattctatacggcggttacagatgaggaacggagtttttatatcggtaagttcatccatgaattggaaagtggcaatgttgacgctttcatgcaccgctttgaagctttctttgcagattttccttacgagttgaatgaccagactgaacgtcattatcaagtcatcatatatttaatattcaagctgatgggacaattcacgcaggcagaagtacatagctcacggggacgtgcagatgcggttgtacgaaccccgaagttcatctatattttcgaattcaagctgaatgggactgttgagcaggccatggagcagattgaagaaaaaggttatgcttttccttatacggcagaggatcaacaagtgataaaagttggtgtagagtttagcgcagagaaacgaaatgtagagcgctggatggtagcgaaagaaatttaatataaaattgattatgaaaaacttaatacgaaatgtctgggtttgcttggggctgatggtgcttcccttcacagcctccggacaacaaaaggataacattacctatgtgccggctcaagagcttttactggtaggcaaagcaactaccgaaggcgaatacttccatcgggtagatacagccaagtatcgtacaatgcctcccacagtgaagaaactattcacaaactctgccggtctggctatctcttttacaacgaatagccccgtcataaaagccaaatggatggttcctgataattaccagttacccaatttgaccagagttgctcagaaaggtctggatttatatatcaaacgggatggaaaatggcaatttgccggagtagggataccgggtggtgtgactacggaaaaagtgcttgttgataatatgggtacggaagagaaagaatgtttgttatatctgcctttatatgatgaactgaaaagtctggaaataggtgtttcttctgatgcacacatacgtaaaggagaaaatccgttcaaagaaaagatagtggtatacgggtccagtattttgcagggagcatctgccagtcgtcccgggatggcttatccggctcgtttgtcccgtagcagcggatataattttatcaatttaggattgagcggaaacggcaagatggagaaagaagttgccgagatgttggcggatattgatgcggatgctttcattctcgattgtattcctaatccttctcccaaagagataaccgaccggactgttgattttgtaatgacgttgcaccagaagcatccggatacgcctattattgtgatacagacattgatacgtgaaacaggtaatttcaaccggaaagctcgtgagaatgtaaaacgacagaacgaggccatcgctgaacaggtagaagtattgcgaaagaagaatgtcaagaacctgtatttcataaaagaagatcaattcttgggaacagaccatgaggggactgtagatgggacccatccgaatgacttgggattcgaccgaatgttgaagaaatataaaccggctatcagtaagattctgaagatcaaattcaaggctgaataacaggaatgaaagattataacagagacagatagaaaaaataaaggtcaattcatgggggtgaattggcctttttcttttgcaaatgtgttaagttgctgttggtattttatagtttccttaaacctttatcttctaagtatttgattaattcttggggacgatcagtttgtatcatagttgccttatgttccagtatccatccccaatgcttatctttaccttctaatagggcgttttcgtcatcatgtccaccgcatagactatcccatagagtattcatccatacccggctaccagattgtacaattttatcaataacctttaaatttgaagtctgttcgtctttgaagcagagttcataggctattggcgtaaagtctttaataaaactttcggtcgcttttatatcttcttctttccataaatgaatgataggcatatagagcatactggtattggttccatattcctcttgaactttctcgacaggataccttccttttataatcacttgtttttccattccacattttcgaatgatgggaagaatctcctttatatatgttccgcctttatctatattgaccagaatacgatctttacatgtcattaacgcttcttctaaagtgggtatggatcggcgggtctttataccgtttccacttttcagcacaaattgttttagttctgttgtcgtatagtttttaatggcgccttttcctgttgaagtgcggtctagcgttgcgtcatgcatacaaataaagttgttgtctttggtttgctgaatgtcaagttccaccatgtctgctcccatagcgatggcattctctatacattgtatggagttctccggagcattcctccagtcgccacggtgagctataacaaatacatattgagaattcttgtcgtgaagattcctcaatagtttatcaattctggattctgcttcagcagataatgaaaccagaagaactgataatagaaatataattttccttgtcatacgtgcttttcttaaataaaatgttttgatctatatttggtacctatgaaaaactatcctataaagttatcttaatcctttttcttttaaataagagttgacaagatcagagtaatcagtttgcacaacttctattttgttatctataaaagtttgaaggtgcgaatatttactattcagtagatcgctatcccaatctaaatgattggcataacttactaacttgacatctttaatagctcccattagttcagtgagagatgcattgtctattccgaattgtaccatttgtactttactgtaatatttggcgaggacttttacttctgccgcagtggatacccatggaaaaggaatggctccagggttaatagtattcatttcttcaatatatgatgtactggaaccagtataatagcaaacctggtcgatcatccctttttctgcaaccgttttaatgattttacctaaaagacccttctcttttacatcgacacaaacatagattttgcctttcgcagcatccaatacttcctcaagtgtaggcactttgtattcagtgatacctttagaaccttttaaaaaatattgataaagagtttgataagtcatattggctacagcaccagttccgtttgttgtagcattaatggttgtattgtgcatatttacgattactccgtcagaagtagctctagggtctatttcaatcatatcggcaccgacttctattgcatattggatagcgggaatagaattttcaggaattccgtcacgtattcccttataggtgttgctacgatgagcgcaagtccacattttcagacttgtgttgctggaaagattctttaagtcggttgttaaacttttagtgtcaggttcttcacctgggtcctccgggtcttcattatcatccggaggagtcggctgatttttgttttcatattcatcattggaagagccgcaactggtacacatcacttgcccggatacaagtaagatgattgccaaaagaaaaaatactttcttcatagtctttttattttatttattagataatgtaggataggctatcgaaataacctatcctgtttgatttgaattattttactgtagcagtgtgttgagcgtcttttgcacgcatcggccagcctgttgttggtaatcctttcacatatttggatgacagggccactaataaacttttcgattcatcttgagtgttagtaatggccacatagatagtcccgtctgcatccactaccggtgaactccagaatttgccttgtgttgcagcccattcggatgcataagcactttcgctgttagcaattgctccggccacatcaagtacggcaatagcgtcagtaccatttgcgtcaaggatatagaaattaccacgttccgtaccgaacaagatatgtccatccttatcaataacaggagtactgctgacactttctgatatctcatattgccatttgatagttccacctgctgacaatgcaacaattccgccaggcatatctccctgacttttcaatgaggcatatacagtgccatctgtgccgataacgactcctccctgatcttgtttgccggtattctcaataggggtagtccaacgtacactaccgtcactggcaacggaatagatggtagtagtcagatcagatgtataaatcatgccatatacatttccttcattgtctatggccattgatgcatgacagccgctgttcaaaccactgtcaaatgctctccatgcccatgggctgaaagtattgtcgtctttagccatagtagcttttgctacaccaaacattccgtagttggtacacatgatatacatcattccttgtttggagataacaggacctgcataaacacctccggcaggaccgctggtaccatctgcgttagttaaatagctaacacggtttcctgttgttttgtctactgcgatcattgaaccggtgcttcccccattaccacagtatacatatttatcatcaaatgctggtgacacgctacgcattttggcattggcggcgttacctttattccagaaaccggtagtcggatcattgaaagtaatccatttcttatttccatcaggattgatagcaaatagtttaccattgcttccgtcacctgtgccaatgtagattgtaccatccgtatctacagacggtgtcatgtttgagcctcctgttgcctgcgctccccaagatggatcagtcatgtcgaatgaccatttttcaatacctgaagttacatcataactatgtaatatgtggtcattactattgatgtaaaccgttttttcatcaggagaaagagcggcggaattggaaactaacttggctaaatgagtggaggaggtccatagtaatgtaaggtctcctttttctactactttatcggtaatttcaattgttttccggtagaggttcgatcttccactgctgtcggttatggtcaaactaacaacaaatatacctttctcattgtacacgtgcttcgggttttcttcggtagaagtcgttccatccccgaaatcccatacataagtaaagttgccactacctccataagatgcgttagtgaattgtatttcaccttctatttgccctctttcgggagcgattgagaaagttgcggaaggaatgtctttcccggcattgtcttcgttgctgcatgcggcaaataataaaagacaaacaatatatatgaacgggcatatccgtactttatttttaatagttgtcatacacataataatcatttaaggttttgttattaatttcctgtatatcccgcatatccgggattttgtgggtaggctaccgtaccggccatgtcaatctcatcttgaggaatcggataatacatcagataagtacgaccatcaagtgtttctagcaattctaagcgatttgtacgtttgatgtcctgccagcgcatgccttcagcataaaattcacgacggcgttcgtccaagatcaatgtctgatattctttgtccgatagagctttgattgctgcttcacttggagcggtagtatatctttttttcatatattccactaatgcggcggctccgttcgtttttccgagagcttcggcttttatcagatacatttctgaaatacgggagattactaccggtgtgcaggtataatctgacgtttccgccaattgataagttccattcggatatttgattacgcggttggcatcttggctggtgaatgtggcttttaaccgtacgtctcctttgcgtgaaagagtattatcatcagcaaaaagactattataacaccaatcagatggagcataattccatgaaccgtccgtgtcattaacgtataatgtgaagtttagaggactggatgctcttgaattattaacataggcaaatataatttccggacttgaatttcctgcaacccaatttttagagaaatccatagcggtggatgcgagcgagaaactggaattagctaatactgcttctgcatagtttgcagcatccgtcatcttgttctggaaaagagctacacgtgcagcaagtgcatttgctgcgtcagaagatacgtaccatttggaatctgcttttgacagtaagcggatagctttacccaaatcttcttcgatgaatgtccatacttcagcttccggagagataggaaccacctcttttgaacgtttacgcaggatggggacatttccataatgagaggccagacgataataaataaatgcacggaaatagtaagagacaccacctacttttttcataagagcactttctttattttcggaagcttcataagtttctacgagaaaattgacctgatgcaatgttgtaaatgagtttctccaaaaggagagaatgttaattgcctgattggtatacgagggagacatttcgcatgggtctgtaatttgacctcctccgggacctgctttgaaattttccccttgtatatcatccaaccaccagaaagtgaatgtataattttccatagtggcgtatactccatttaatagcttttcgagatcatcatccgtcaaggctgattgaggaattgcatgtcgggggctgatgtcgtccagccagtcagaacagctcgtgccgagtacagttatggtcattaaaaccagagtgaataatagttttatatttttcatatcgttagttttagaagttaatgcttgcacctatgataaaactctttaatgtggcttgttctccgaaatctgctccgtagctgttgcctgtcggattactttcgtatgagaattccggatcatatccggaatatttggtcagtgtaaaaaagttgtcgagagaaacaaagatgcgagctcccgttacatgtatttttgacaacagagaatgaggaaggctatatcccaatgtgatggttttgaatttgaaataagaagcatcttccagatagcgggtagaaacaagattgtttccgaaaccgccggtgaacgtgcctgccaaagtagggcgtggaacagtgttgctagttccttctcccctccagtaatggttggcggcatattttgatatgttatagaattgttccgaatcgaccagtgtgccatttttgtaacctttgatactgctggacgccaagccgagatgttccgtaccttctgttcccccgcagcctttccatgctgacaggattttacctccggctgcaaattggcagaaaatggataagtcgaagtttttccagttcatagtcgaagtgataccaccataaatgtcaggtgtaacctttcctacatacatgcggtcatcgtctgtgatgtctccgtcattgttgtagtcaaagtacttacaatcaccggcacgtactccttttgcgtagagtttgcttggtacttcctggtcggtttgataaataccatcctgacgcaacatatagaaagcactaaccggtttacctaccattaaagcatgcattactttaccggtattggcaccaccaccgttgattttcatatcaagtactccatccaatgacaatagtttgttttttgtataggagaggttagtagcaagctcccatttaaaaggaccatcgaatattttaccgctcaccatcacttccaatcctttgttctccagcgagccgatattggctgtccgggtagtatatcctgttgtagcaagtgtactgatattataaagtaatccgcttgtcttttgatagtatccgtctacagatagcgccagtcgtccgttgaatagctctgcgttgattccgacattcacctgattagctttctcccagataagatccgcagcatctgctccgattttaaaaccggatgaaccattataggaatttcctcccgaagttactaatgacatagctgcccagttactgataccatccatactgccagtcttaccccaactggctcgtagctttaagtcattcagtggcgtgcctttagggaaaaaaggttcgttgataatccgccacgcgaaagaagcagaaggaaatgttccataacgtttatcttttgagaaacgtgaagaaccgtcacgacgcatcgttacatttaagatatagcgattatcccaattcagggcggcacgtccgaaataagattcgagtgcatatgcattatatccgatactacctgcgtagatgttagaaccggaatttatcagaccgaagctggaagaaggataagcaccgtttgcgtaattatcactataagccccaaaagtttcataattatactcttcgtatgagtgaccaagcattgctgaataagttagtttatcccaactattttcatacgaaattacgttgtctataacatatcggtaacttacatttttctgttcgctaagtgcgccccatcctgcatttttggaacgtgcgtcatgtttctctgaaattgttttcttttcttcatcaagaataccgtatatgctgaatgagggggtgtatttgagtcctttgataggagtaatatcaaaactaagggcagctactccttgtttcttatgtacagtccagtcttcttcattaatcagcataacgggattatgacgacataattctgttgacatcactgtatagcctccatcttcccgataagctccaatccatggttgttcttcacgggcagtacgaatcactttcaaactggtagatgactcttccactttatcgaaacggctgtaagatcctgtgagattcagattcagtttaaaccatttgttcagctgatgagtaaattttgcccgtaggttggtttgctggaatccgctggtacggatgataccttgttggtcgttaaatcccacagaggtgaaaaaggtagttttctcattacctcccgagagattgatagatgccgtagtagagtgtgctatatcacgttgaatgagtccgagccagtctgtttcggtaatccggtcggggataaagaatgattttgtgtccttcttctgcacattccaattatctacggctgcttgcatagtacgagtatattctgctacatttgccattggtatatcgttggcaatccatccaaggctgtggcgtacactggcatttacgcgtgttttactgttggtgttccccgattttgtggtgatgatgacaacaccgttgttagctcgcgaaccatagatggcagcagctgaagcatctttcaatacgtccatgcgttcgatgtcgttggggtttagcataggcattgattcactgggaactccatcgaccacatacaatggggtgctgttacctgtgatggatgcaataccgcgtacccgtacactcggttgttcaccgggggtaccgctggcagaggctacatttacaccaggagtacgaccttgcagcattttagctacattgtagtcactgccttggtccagatcatccactttcaggctactgatagaagtagttactagtttttcggactgggagccatagccgactacaactatctcatttaatgcaatgctactttctttcaaatatattttcagattgtttttattgccggctttcacttgttgtgagtcaaatccaatataagatactgttagtggttggttaggatctgctacaatggtaaagtttccgttaatatctgtaatgactccggttccttttccttgcatgacattggcgccaataataggaattccactttcatctagtacggttcctttaatcgctctcttttcattacttctttgttctgtctcctgctttaccaatacgatggtgttgttggtaaatgaataagatatattcaaaggagtaaatacctgtgagagcgcttcgctgataggtttctttgtgcagctaattgtcactttagtctgatcgttaagaacatgattccggtatacaaaagtatatctcgtttgctgttctacttgtttcatgaaagtttttaccgtgccatttttgatatgaatggacacatttccttcttgggcaaacactcccgaagggaataaaattatagcagcggataaaatggtaaagtttctaaaaataaggctgttccgcagtttccttctcaataaaaatgttaactttgtgatattcatagttgataatgttttgatgtataaaattttatcgacttccatacaaccaaaggattgggcgattctttggttgttcttttttgattttaactactatgtgttttccataagctcctttcttttaaattagtaaatagttattatatctttatgtatctcgtacttaaatccgtattgtatgcttaaggatcttatgacattctgtatactttcgtttcggaaagatcccgatagtaaatcttgtgcgatttgcttatgatgcaatctgatttccaccccataccatcgttctatctgggctattacatcaattaatggtgtggattcaaagatgaggtaattatctctccatccggcttcaacatgggcatccgctttgcttattcgtagtgttctgtccatagcggaataggttgccttttgtccaggtgaaagcgtatattcatggggaagtgaaccacctgatattctgattcgtccgctaagtaaagacgtttctacaatgtcttttttataggtctttacattgaatgaagttcctactacttcaatttgcagatcgttgattattaccttgaatgggcaatcgggattcttggcaacatcgaaaaaggcttctcctgatagtttgacgaggcgttgcttggagttgtttacatcatattccaggtttgtagccgcatttagatgtacaaatgtaccatcagggagagccatttctgctttactgccagctctaactgttacagcaaccatttgactttccgggttattcatccatgtataaagtccaaaagaggatgataggatgatagcgataatggcagcatatttcatatattgcagccaacggcgtctccaaatgatttgttgtagttcctttcgaatttgctttttcatcataggaggcatctttatctctactgtgtcgttttccatatctatcatggtattccataactcttcgtcaggtatgttgttgagttcatttctgaactttccaatatcggaagaggtgattcctttttcgatgtactggcaatataactttttaaattgtggactcatattattggtgtttctataggttatacgtaaatacataaagggagtactagactttttttatgttgtagagcatagaaaaagttaggaatagtaggtgtttgtagagttttgtggagttttaattattcctactgaaagtgttattcttgttacaggaagaaaataaagagaatattatatttcatcatttcgctgcgaagaatcttcagggcggaagtcagatagtttttcaccgtttgttcggagagatccagttgttcggctatttgcttgatggggatatgtttctccctgcttaattcataaatctcgtgttcccgttgtgacagaactttcttcgattgttgaagttgttgcaggaattcgtcgtacaataagatatcttccggcgatacgtcagttgcctggttctcgcaatactccataaagtcttcgaattgcagttcgttgacttgtttgcggaaataatcgattacctgatgtttggcaatagtgaaaataaaggcttgcagattgccgaagctattcaactggttacggttgtcccataggcgtaaaaaggtatcctgaacaatatcctgtgtcagggaacgattttttagttgtttaagaacaaagctgtaaagtcggtcggcataggcttcataaatctgtgtaaaagcctggtaggagccgttgcgtagttcttttatgcactgtatttcgtctattttcatcctttctgcaatagaagtaggtcgggcaaatgtactgaaataatttagaaatcaacaaatctatgtgaataaataaagagaaaccgatgtccggtagttggcagatgaattttattttgcaatcatatattgagctttattgtgccgtctcttgctttccgctaattaattttgtatctttactgttttttacccttgtaaagacaggtggtcaccttatgcagtgataaatatcaccttataaggtgacattaggctgtttacaaagtgactattgtcccgttacaaccggacaactacccgagtgcataaacaatgataaatctctgcactgaaaatctttattctctgcactgaaaagtcttaaatataacaataagattatggccttttacaatttaaagaaaaagcctgccttgactactaaggaaggagaaacggaaacaatgtatgccgacattgtctacagtggaacgattccggcagaacgattgatccgtggtgttgctaagagaaccggatttaaggaaggagtgatagaaggtatcctgatggaactgaaagacgatgtattgcaatatctgggtgaaggataccgcgtcgaattgggagagttcggcttcttttcagccaaagtgaaagcttcccgattagtcgcaaataagaatgatattcgttctgaatccgtagctttcaacggggtgaatttccgtgcttccaagagtatgcgtgtaggtattcgcggagatttggagcgtagaaagtgtgtcgatttcaacacttcgcgtaagtggggcagagacaatctgaagaaactcgtcctgcaatatatcggagagcatggcttcatcacaagagccacttatacgcaacttacaggacgcctgaagaatactgcattggacgatcttaaatcttttgcagccgaaggcattatcaagcgagagggacggggtaatcagatgcatttcattgcaccgccacgaaaggaaccggatggcgagtagtgaaatctaacggaatatcgatggaaacctttgtcgtacaaggttggagattgggaacagaacagagaaatgaagaggtagtatctacccgaatggattgaatcagtgcaaaatgtggtataagtataatgtatggctaaaaaaatacagtacctttggctgtgaatacaggtaaaacggtgatgaggtgtctatgaaacagccttacagtggatttctcgtccgaatgttgtttgaccgataacacagactataatatgttggatatcatatactacttcaatatcttcggttgtctgacgatggggatggctctgctgttgattcaaacagccccacagctgataaacccgcactaccgcaatgccaaacgattcctgggtattgcatcgattatcgtggctctgtgcaatgcgcttatcctttacaacagggtacaggagagcgttgccgagatatttgcaatgcctgtgctcgttgcggcacagttgcaggcggcgctttttacttttatcgtgctgatactttttcattcaccatacgtttgccggcaaaatattttgcgacacctctgcccgacattgttttttgtgggactctatctattaacgatacttctatttcctgatgtgaggatctattcggtggatgagtatatagcgaatatcacgaatccggttcttttgttaagaactgtatttgcggctacttatctgacgcagatcgtgatttacgtccgtttattccggcgtgagcaacggaattatatagccaagattgagaactatttctccgacaccgacaaatatgaattccggtgggcttcgagactgttctacgaggctgcctgcatcggtattgccgttctggtgttcagtatatttcctgccccgttattcgacggaataatcacggtggtgattacagtgtactactttgactttggagtgaggtatatcaactaccaatacaaactttactatgaggctttgcccgcgatagaggagaaggaagagtcgcagctgacaaaggagagtgaaggagacaaggaactggaagatgaaaaggcaaaactattattgtatctccagcagggtgttgtgctgggcgactatgccgaggctctgcatatcccggaacggaaactatctgtattcatcaattcgacttacggggtgagtttcaaacgttgggtgaacaataaacgggtagaatacgccacagagcaaatggcgaaacatccggattatacaatggagaggattgccgagctttcgggttttgcccacaaaagccatttctgtaaaatcttccgggagataacggggggatcttttaccgagtacaaaaatagataacacctccaaactgttgtatatttggcgatacagcttgttccaacatacaataaacccacaaaaaacacttgtgttgcacgtttcgacgtcagatatgcgtaaatgtgcacccatcatccaaaattttcattatatttttgctgcgtagggcataaaccgctctgcgcttttttgttttcccatgaatattaatcaaatataaaacaacatgaaaaagattttttctttgttagtgctatgtgcaacagtagtctttgcttcgtgcagcaaggacgatccggtaacggatcccgtgccggaaggtatcgtcgtcaccacctacgaagccctgctcgacgccctgcagacgggcggcacctcggccgatgccccgacactcattacgctgggcggcaacatcacggtacccgcgggaggtgactacgacacccctcccataaacggcagcggccacttcaagatagacggcggcggccacaccatcacctgggaaagcaccgccaacaaccaccacctcctcggcaataccagccccgacgccgatgccgtttatatcgaactcaccaatattaatctggaccgacaagatatgaacgccgcagtaggtgtttacaacggcaagattacgctgggcaaagacgtggcattgagtgggcaagatggaaacatgattctggctaacggcgagaaagcggcattggaactgggtgacggctgcgaattgtcttacgcggcaggcagcagcccgtgctgtgcaagcgcctggtttggcgccatcctcgtgctgaacgggggaaagaccgctgccggggcttacataggcctggactgcaatttttacccggccgtctcctatccccttatctccgttccgaaagccctcacgggtgatgtgcacctccttctcaaaatgatcggtacaacccccgtcgcccaaggcattggcaattaccaactgacgcaggcggactgcgaccgtctgaaagtgaatccggagtcaacggtcagcctctatatgggacagcgtgataagtacgacggcaacttcgagcttcacctcgaccctgcggcaagttttcaaatcaagcttcgcccgaagaatttcacaccccccacctccggcaacatcgacgtgaccaacatgaccgacgtcgtggcgcagataaccatccgggcagccctcgaagcaggccacaccgacctcaagctgacgggcgaactttccaagataggaataggcggtcagtggggtacatttgccaataatacacaaatcacgacatgcgacctcaccgaagtgacgggctggggtacaacgccaactctgcccgaactcgcctttaaggattgcaccaagttgcaggaggtgacgctgcccgatggcgtgcaggtaattggagagtatgcctttatccgttgcgccgcgctgactacggtgaatctttcgcaggtcacccggattgatgaatacgcattctgggaatgcacttcattgaccgcactcacgctggataatgtgacaaccatagaccatgatgctttctacggatgcacgggcctcgaaacgctcaaaataccgaagtgtacctggttcggcaattatatcgtaacgggctgcaaagctctcacccggatagaagccaccgcagccggaaatttcgttgacataagtgatggtcgcagcagtatagagcgcaccgccgtttttcacaacagaaccgctcattccggagataacgcattcgaccccgccaagtgcgacctcgtgctgaaccccgacaagtacgagaatggcggtgccgttcccacagcctctgccaacaatgaatggactgtggcgcagcatggcggccttatgaaatggaagagcatcacgccaccgtaatccgcgcctttcccgaagttgaacttcaaggcggtctgatttattttttgaaatccaattttatgcctgatgcggtagacgacatatgttgtcgtaaaaagattatatcttaattagtagtcgattaaaaacgctctgccatcggcagattacaaaatatatctccgcccaacttgcaaaaagggtccctactgtcaaattgtagggatccttttgctttatacaatttactccgcatgacttaggaaagctgtcctctgtcaaaaggaagattatcgaataacggagtttttttattgtcgaattgtataaaaaccggtcgtgagtttgtttcctgagagaattttgttacttttgtattcgaaagagttacttgaagatactattctgcaaatcgctaaaatgcgcacagttaccaaattgttatctctcaactccccaaattatgcaaagtgtttattcttcaattggttatcttaaccgcgaataatctaaaataaaaaaacgatgtttcagaaacttgtagctatagagccgatcagtctggttccgtcggccgaaaaagcgttgtattcatttgccggtcaggtggtgatgtatcctgacatacccgtgaatgatgatgaaattattacccgtatcggagatgctgatgcggtgcttttgagttatacctcccgtatcaaccggtatgtacttgaatgttgtccgaatgtgaaatacattggaatgtgttgttcactctattctcccgaaagtgccaatgttgatattcgttatgccaatgaacggggtatcacggtaacaggtatccgggattatggtgacgagggagtagtggaatatgtagtcagtgagttggtgcgctgtttgcacggctttggacaggaaacgtgggaagatttgcctcgtgagattaccggattgaaagtcggaatagtcggactgggtaagtctggcggcatgatagcggacgccttgaaattctttggtgctgatatttcatattatgcccgcagtgagaaagaagcggctactgccaaaggatatcgctttttgccattgagggaactcctggcagagagtgaagtcatttgttgttgccttaataaaaatacgattctgttgcacgaagaggaatttaagcagatgggtaaccggaagatcttattcaataccggtttgtcgccagcatgggatgaggctgcttttactgaatggctggaaggtgataacctttgtttttgtgacacgataggcgcattggggggtgagcaactgctcaatcatccgcatgtacgttgtatgcaggtgtctactggccgcacgcgtcaggcgtttgaccgcctgagcgcaaaagtgttggccaatctgtcagaatacaatgggtgaaacgatattaatcagggtgctcactactgaccaccctgcaatatccgatgtggcactataaatgtctactacggcatgcacttggtcatttttgatttctaccctttgcgtatctcccacaaatccgggggtagattgtatggatacctgcatgttctccggaccgacagaagctcgtgaggcggcaactgtaacattcactttggttggaaagaggcgaatagcttccgcagcacttccggagaaaacagtacgttgctccgtttgcaaagaatcatcataaacgggagttcctttgagtgcgttaggacctttttcattgaagaagcgggccgtcgtatttcccatcagagaggcagttcttaaaacatcgaatccaccggtagctccggatgcgatatagattcgtgtgccatttaccttggcggtttctgccacttcccgatagaatgtctcgtctgccaaagcaccgatagacaaggtaatgacagacgttccgtttttcaatgccggcaaagccaattcccgcatagcggcaggagaggccgattccaccagataatctggttttaatgccaataactcttccaatgtggcgcaagcaatgcaaggcttgccatgttgctgcattttatgaacgatgtgcgctgcttttgatgccgtacgcgaatagacacctaccagattataatctggcaataagcctttgacaactgcatccgcaacgatttctgcaagtcgtccacatcctacaatgactaactttttcatgcaacaaagataatacttttattggtaagagcttcggttggtaatatggtatttattttcatcaggtatgtatccggggttgttcctttaatttatgaactatttgtaataagattacgaagattttctctacatttgtctttattaatcttgtaatcttctattaaagtttaatactccgatgaaaaaaaagtacctgatatttcttttacttctctcttttccattatatacccgggccgataagaccctggactcactgttgaatgtgcttgatttgacgattcaagaacatgagacgtatgtggttcaacgtgaatcacgtatcaagcatcttaaagaactgacacacggaatagaatctaattctgcggaacagtacaatctgaacagtcagatatacaaagaatataaagcctttatctgcgactctgcaattcactatttgaatgaaaatatccggattgcagagcgcttgcgtgatacggaccggaagatagaaagtcagttgcagctttcgctattattatcatcaactggaatgtataaagagtctcttgatgtgctggaatcggtagaccgtcggaaaatcattcctcgtttaatagccgattattacacctgctttgaccatgtgtatggcgagttgggcgtttatacacaggataaaaccctttcgggacgttattggagtatttcacaggcatatagagattcattatatgctatattgcctccggaatcggaagaatacctgctgatgcgtgaagcatcatttcgcgatcaacgccagtatgaggatgccctgaaagtgaatgatctccggttgacgaaaatagaaccatatactccccaatatgcgatggctacttatcatcgttctttgatttacaagtacagtaatgatagtctgggagagaaacggaatctttgtctttctgctatatcggatattcgttctgccattaaggaccatgcttcgttgtggatgcttgcccaattactttatgaagatggtgatatggaacgtgcataccaatatatgcgcttttcctggaatgcgacaaagttttataatgcccgtttgcgtagttggcagagtgctgacgtgctttcattgattgataaaacctatcaggcaatgattgaaaagcagaacgaccgtcttcaacagaacctgctgcttatcactgcactgttggtgttgttgattgtagctttgggatatatctaccgtcagatgaaaaagctggcagatgcaagaaatcatcttcaggtagctaataagcagttaaacggattgaatgaggagttgaggcagatgaatagttgcttgtcttctaccaatatcgaactctcggagtccaatcagatcaaggaagagtatattgcccgtttcatcaagttgtgttctacttatatcaaccgtttagacgcttaccggcggatggtgaataagaaagtgtctgccggacaaattgcggaattattaaagataacgcgttcccaagatgctcttgacgaagagctggaagaattgtatgcaaactttgatacagcctttttgcatctcttccctaactttgtgggaaaattcaatgacttattacaggaaaatgaacagattttaccgaagaaaggcgagttattgaatactgaactgcgcatctttgctttgatacgtctgggtattgaagatagttcacaaattgcggagtttcttcgttattcagtgaatacaatttataattatcgggcgaaagtaaggaataaagcccgtggatcgagagaggattttgacgatttagtgcgaaaaattcgctaattcggactgtaaaacaaccacttttttaggtatacgttctgaatgtaaatagatgaaaataagtggattatcgttttgtatgatccacttattgccccctccttgttagctcactttaatttctttatacttttgacctgtgcttcgaaagtaatgagagtagcccattgctgacgagcgtcttattattaactttaaaacttagtacgcatgaaaaaaaacaggcgaaaaatcctttcggggagtcgcaagattttctttgctatcttggcaatgtttttatctttgagtgcatccgcacagcaaattactgcatccggtcagatcctggatgctcaaaaagaaccgctaatcggtgttagtgtacaagagaaaggtacgtctaacggagcaataaccgatttagatggcaacttcacattaaacgttaagcaaaacgccattttgatattctcttatgtgggttataagtcgcaggaggtaaaggcagcccaccagatgaagatcacacttcaggaagataatgaagtgcttgatgaagtggtggtcatcggttatggttcggtgaaacggaaagatgtgactaccgctatctcttccgtatctaccaaggatttggatatgcggcctattgtttcggcaggacaggccattcaaggtaaggcagccggtgtctcggtgattcagcctaacggtacgccgggcggtgaaatgtctatccgtgttcgtggtactacttcaatgaatggtagtaatgatccgctgtatgtagtagatggagtgcctgtagacaatatcaagttcctttctccgaatgatattgagagtatgcagatattgaaagatgcttcatcggcatctatctacggttcgcgtgctgctaacggagtcattctaattactacgaaggccggtgcagccggtaatgccaaagtttctttgacagcccagttcggtttgaacaaagtagccgataaagtagaatccctgaatgcagcacaatataaagaattgcaggatgaaatcggactagtgtctttgccggacggattacccgaccgcaccgactggtttgatgaaacgtatacgaccggaaagactcaaaattatcaggtagctgtatccaatggtaatgagaaaatgaaatattacctttctgcgggttacctcaaagaacagggagtgttggacatctcttattacaagcgttacaatttccgggtaaatttggaaaatcaggttcgtaaatggctgacagtaagtgccaatatctcttattcagattatacaagcaatggaggcggagcaatgggaacaggctcgaatcggggtggtgttattctggctgttatcaatacaccgacttatgcgccggtgtgggatgctttgaaccctaatcagtattacaataacttctatggagtgggtaatatcaccaatccattagaaaatatggcccgcgcgaaaaataacaaagacaaagaaaaccgcttgttggcatcgggtaatatattgctgactccatttccggaactgaagttcaagtctactcttactcttgaccgtcgcaacgccgttaataccacttttcttgatccgatttctactgcttggggccgcaatcagtacggtgaggcttcggacaatcggaatatgaacacagtgctgacatttgataatgtattgacttataataaaaatttcaagaaacatggcttggaagtaatggccggttcgtcatggacggattcagactattcaaatagctggatcaacggctctcactatcgtagcgatcagattcaaacattgaatgctgccaataaaatatcttgggataatacaggtacgggtgcatctcaatggggaattatgtcattcttcggacgtgtagcttataacttcgacagtaaatacttggtaacagctaatcttcgtgccgatggttcttctaaattacatcccgatcatcgttggggcgtatttccttcattctctgcagcctggcgtatttcttcggaaaagttcatggagaacctgacatggattgacgatttaaaattgcgcggtggctggggacaaaccggtaaccagtcgggtattggtgactatgcatatttgcagcgttacaatatcggccgtatcgaatggtttaagaaaggcggcgaaggtgattcgactgattatgcaaatgctgttcctaccattagccaggccaacttgcgtacatctgatttaacatgggaaaccacgacacagaccaatataggtctggatctgaccctattgaatggacggttgacgtttaatgccgactattattataagaagaccaaaaacatgttgatgaatgtgtcattacctgccggtgccgcagccgctacgtctattgcccgtaacgagggtgaaatggtaaataagggttttgagctttctattagttcgaaaaatcttcgtggaggagcatttacatgggatacagacttcaatatctcttttaaccggaataaattgacaaagctggaattacagaaagtttattacgatgctaaaactgcggatgtggtgaatgactatgttgtacgtaatgagccgggccgtgctttgggaggtttctacggttatataagtgatggggtagatcctgaaaccggtgaattgatgtatcgtgatttgaacaatgacggtaaaatatcatcttccgaccgtacctatatcggtgatccgaatcccgattttacctatggtatgactaataccttttcatggaaaggctttaatttgagtatctttatccaaggttcttatggaaacgatatttataatgcttcacgtattgaaacggaaggtatgtatgatggtaagaatcagtcggcccgtgtactgaatcgttggaaaatacccggacagataacagacgtgcctaaggctaatttcaaattactcaattctacctattttgtagaagatggcagttatctaagattgaaggatgtttccttgtcctacaacgttaaaggtaaactgttgaagaaatggggaattacccgtttgcaaccttacttcacggctactaacctgctgacatggaccaactattcgggaatggacccggaagtaaaccaatggggtaacagcggtacggtacaaggtattgattggggtacttacccgcattgcagatcatacgtgtttggtattaatgttgaattctaatgaaaggaaagattatgaaactaagaactatattttacggattaacctccggcttgctattgggactttcttcctgctcgctgaattatgagccattagacacctattcggatgtgacggaaggggtgacaagtgatggtacaaaaatcgtattcaaggataaagctgcagttgaaagtcatctgacaacgctttataatcaaatgcgtgaccgtcaggaacattggtatgtggatttacttttgatttcagactcccattcggataatgcttatgccggtactaccggagcggaagttgtcccgtttgagaataattcgattgaaggttccaattctgtgttggaacgtgactggaaccgttatttggaggatgtggcccgtgccaataaactcatttgtaacattgacctggtgacagataattcgttgactactgccgaacgggcgcaatacaaagcagaagcgaagatattccgtgccatggtaatgtttgacatggtacgtctgtggggtgattttccggtgattacaacggtggctgatgatattacttctgaaaacattgatgaggtatatccgcaatatttccccaaacaaaatacggaacttgaagcttatcagcagattgaaaaggatttgttggatgcagtattgtatgctccggacaatacgccggggaataaaacgttgtttaccaaatctgtagctcgtaccttattggctaaaatatatgccgagaaacctttgcgtgattatacgaaagttattcaatattgtgatgaggtgaaagcagacggttttgatctggtagatgatttcagtgatttgtttggaatgaatgctgcgggaacagatgcaaagatgcgtaatacaaaagaatcgattcttgaagcacaatttacatccggagcaggtaactggtgtacatggatgttcgggcgtgatctcgtgaattggaataacaatttcacgtgggcgaaatgggtgactccgtcacgtgacctgattagtgctttcaaacaggaaggggatgaagtccgtttcaaagaatcaatagtctattacgattgtaattggagcaactattatccgtctgataattatccgttcatgtataaatgccgctctgccaacagcagtatcatcaagtaccgttatgccgatgtcctgttgctgaaagcagaagcgctgattatgcaggatacgccggatttggaaggagccgccgatataatagataaagttcgcgaccgtgccaaattgggagcacttcccacctctgtccgttcaaacaaaaatgccatgctgaatgctttgcttaaagaacgtcggttagaactggcttttgagggacaacgatggtttgatctggtccgtctggacaaggtagaagaggtgatgaatgcagtgtatgctaaggattcaggtcgcaaagcgcagatttacacttttgataagaactcttatcgtttgccaattccgcagtcggtaatcgacgcgaatgataagattcaccagaatccgggttattaattcaactaaaaacatagaaaacttaagattatgatagacatgagaaatatagcattgacctttttaggatgcttcaccatattagctgcatgcagcaacagtgacgatgcggagaaaccggttacacctgttccgactggagatgtgactatttatgcgaccactagcagcctgactcgcgatttgacccgtgatgccgttaatttcagctcgaaagataatttggcacctacttcaatcacattgaatccgactgaacaatatcagacaatggacggcttcggagctgctatcacaggcgccacttgttttaatcttctgcaaatgaaaccggaagatcgtcacgccttccttacggaaacattctctgacgacaaaggcttcggatttagctatatccgtatctctatcggctgctcggacttttcattgagcgaatatacctgctgtgatacgaaaggtattgagcattttgctttgcaaagtgaagagaaagactatatccttccgattctgaaagagattttgagcatcaatccttctattaaagtcattgccgccccttggacttgtccaaaatggatgaaagtaaagagtctcacagatcttactccgctggattcatggacaaacggtcagctgaatccagcctattatcaggactatgccacttattttgtgaaatgggtacaagccttcaacgccgaaggcattgatatttatgctgtaactccccagaacgaaccgttgaaccgtggtaattccgcttcgctttatatgagttgggaagaacagagggactttgtgaaaacagcactcggacctaaattcaaaacagccggactggctacgaaaatttatgcatacgatcataactatgattatagtgatattgcaacggaaaagaactaccccggtaagatgtatgaggacgcagctgcttcccaatacctggccggagctgcttatcacaactatggcgggaatcgcgaagagcttttaaatatacataaagcctatcctgaaaaggaacttcttttcacggagacttctatcggaacatggaatagcggacgtgatttgtcgaaacgattgctggaagatatgaaagaagtagcattgggtacgatcaacaactggtgtaggggagttatagtgtggaacctgatgcttgataatgaccgtgctcctaaccgtgaaggcggttgccagacttgctacggagcggtggatatcagtaatagcgactataagacaattatccgcaactcgcattactatatcatcgcccatctctcaagtgtggtgaaaccgggagcggtacgtatcggtgcatccggctatgctgatagcaatatcatgtattccgctttcgagaatccggatggaacatacgcttttgtactgatgaataataatgaaaagactaaaaagataaccttaagtgatggtaagcgtcattttgcttatgatgttccgggcaaatctgtgacttcctatcgttgggcaaagtcggaataagaaccttaaaacgatcaagacaatgaaaaaaaacagttatattatattggctttggcaggaatgttatccatgaattcctgtaatgatgacgaattcttgcccggtaatccgagtatggaaatcaaagcagagaatgcagatgctctttttggtgacagtcttccgtttacgattaaagcctcggatgtggatgtgcctctttctacgttgaaagcacagcttttttatggagaagaacaagtgtctgaaacggtcatccgtacaaagacaagcggaaatgactatactggtaaaatttttgttccttattatgctaatattcctaatggaaaggcaactttgaaatatattcttcagaacattcattttactactacagaaatgacgaaagaactcgctctggcacgaccggacttcccctatctgacattagtggatgaggaaggaaaagagtaccggatggaacgtcaatccatgtacaagtatagtgtgacaggagacttctcgcaaaagatgaaagcgtatatcaagactccgaaagtgggagagaatgggaacgaattgactttcggctgggagaatggaacgattgaagccggttctacgaatgctatctcattttctaatacggaaccgggaaattatgctatcaagtttaatacgttgacttacgaggcagaaccatttgccaagttaaaggtgaacggtgaagatatggaattggtagagaatgatatctatgcaatcaagttgactttgaagaagaatgacattctagcgtttgaaggggtgcctgattatgataattggtggatagaccaggattattttgaaaagcaggaagatggaacattgaaattcctgccgattgacggaagttaccaaataacagccaatggtaaaatgaagtatttctctgtcattgctttgaagaatggtgaggctgccaagttgcaggatgatggaacaggtgctatctgggctattggaacaggaatcggtaaaccgtcggtggcactttctgaagtagggtggactccggaaaatggtctgtgtatgccacagcttactgcgaagaagtatcaactgacatttatagctggcgttaccatgaaagtggatgatattaactttaagttcttccatatcaataaatgggacaacggcgagtttaagggtgatgctatttctacaacgagtgaattggttaaaatctcatcggacggaaacttgggactggaagaaggtcagaagttcgaaagaggaggtatttacaggtttacagttgatgtgacgaaaggcaataccaaggctgtgttgacagtggagaaagtagggaaggtagatttacctgcaccggatattttctttggtaatgataagatggaggtgacagatactgatatatataagtcggatcaggcgtttacacaaggacaaatgataactgttacaggcattgataatttgaatgaatggtggatcgatcctgacttctttgagaaacaaagtgatggtgcattgaagttcctgccgattaacggagattatcgggtgacagctaatgctgttttgaagtatttttctgtaatggctttgaaagatggtaaaccggccaaattgcaagatgacggaacgggtgcaatctgggctatcggaaaaggaatcggtaagccttctgttacgtcttccgaagtaggttgggagccaagtaaagcgctctgtctggcgcaagttgcttctaaaaagtatcagctaaccttgaaagccggggaaacgttgaagactagtggtgacccggaagtgattagttttaagttcttccatcaaaatgattggggaggagaattcggcaattatgcaagctctattttagtggaacagcttaaacttgcagattccggaaatttggaaatgcaggataataaagcatttgaagaaggagctgtctatcgatttaccattgatgtaacgaatggcaatgcaaatgctgatctgaaggttgagaaaataaattgatctgaagattaatgccggatttttattgaaactatcctgaaagggtatgatgaattgtaccctttcaggattcatctttggtcggaataatgtaaaaaacattaataaactcgtccgcaactaggaaatatcccctgtttgggagtctatataaataaagtatgaacttatttcttatatcataaatgaacatgaaattcaaagcaatgttacttggcttgtctgtgataactgcgttgcctgcctttgcgcagaagcccgtgtatctggacactggtaagcctatcgaagagagagtgaaagatgcattgaaccggatgacccttgaagaaaaggtgaagatgattcatgcacagtctaaatttagttcggcaggcgttccccgcctcggaattcccgaagtatgggctaccgacggtcctcacggtatccgtccggaagtgttgtgggatgaatgggatcaggcaggatggacaaacgattcctgtattgcctatccggcactgacgtgtctttctgctacatggaatcccgaaatgtcgcatctttatggaaaaagtatcggtgaagaggcacgttaccgcaagaaagacatcttgttggggcccggtgtgaatatctaccgtactcccttgaacggacgtaacttcgagtatatgggagaagacccgtatctgtccgccactatggtggttccttacatcaaaggtgtacaagagaacggggtagctgcttgtgtgaagcattatgcattgaacaatcaggagttcaaccgccataccaccaatgtgcaattgagtgatcgtgctctttatgaaatatacctgcctgcttttaaagcggctgttcaggaaggtggaacatggtcgattatgggctcttataatctctatcagggagagcacgcctgtcacaacaaacgcctgcttcgagatattcttcgcgatgaatggggctttgatggcgtcgtagtgtccgactggggtggtgtgcacaacaccgaacaggctattcacaacggcatggacttagagtttggttcatggacgaacggactgtctgccggaacgagaaatgcgtatgataattattaccttgctttcccttacctgaaactgataaaagagggtaaagtaggaacaaaggaactggacgaaaaggttagtaatgtccttcgtctgattttccgtacttcaatggacccgcacaaaccattcggctctttaggttctcccgagcacgggcaggccggacgtgagatagctgaagaaggaattgtgctgttgcagaacaacggtaacgtattgcctatcgatttgaataaagcgaagaaaatcgcagtgatcggtgaaaatgcgataaagatgatgactgtgggcggtggtagttcttctttgaaagtgaaatatgagatttctccgttggatggactgaaaagccgtgtgggttcaaaagcggaagtggtatatgcccgtgggtatgtaggcgatccgacgggagagtataatggtgtgaaaaccggtcaggacttgaaagacaaccgttcggaagatgaactgctcgctgaggctttgcaagtggctaaagatgccgactatgttatcttcttcggtggcttgaacaagagcaatcatcaggattgtgaagattcggaccgcgcttctttaggtttgccttacgcgcaggatagagtgattagtgaactcgcaaaggtgaataaaaacctgatcgtggtcaatatctccggcaatgctgtggctatgccttgggtaaatgaagtgccggccattgtacaaggctggttcctgggttcggaagccgggacagctcttgcttccgtattggtaggagacgccaatccttcgggaaaacttcctttcaccttcccggcaaaactggaagatgtaggggctcataaattgggcgaatatccgggcaataaggaagaactggcacagtctaaacatagaggagatacgattaatgaaatctatcgggaagatatttttgtaggttaccgttgggcggataaagaaaaaatcaaaccgctgttcccgttcggacatggattgagctacactactttcgcttatggaaaaccctcggccgacaagaaaactatgactgcagatgataccatttctttcacagtcaatgtgaagaatacaggcactcgtgaaggtcaggaagttgttcagctttatatcagtgataagaaatcctctctccctcgtccggtaaaagagttgaaaggtttccaaaaagtgaaactggctccgggagaagagaaagcggtaacgctgacgattgataagaaagcattgagcttcttcgatgatgctaaacacgaatgggtggccgaaccgggtaagtttgaggcaatcatcggtagttcatccagagatattaaaggtactgtaccatttgagttgaaataggtagatgtttggttagagattttttaaggagatgacagagagtctgggtactcggaaaacgctaagtgattgcaacaaattgacttagcgtttttttattgcctaattttccctgcgtttgcaaaaaaatagtaagaaagtagtcgtttcgcttggtaaagtgttgtatcagaagtaattttgggaaaaataacaattaaggtaacctaattatggaaaaaggtatttggctggaaatagaggaactgtataaggagtttcagcaactcggtatcagtcagtcggtggactatgagaagtactacctctattctcttattacccattctacagccattgagggttctacactaaccgaaatggatgcacagcttcttttcgatgaaggtgtaacagctaaaggaaagccgttggtatatcatctgatgaatgaggacttgaagaaagcatacgagcttgctaaaaaggaagcgcaacgcaatactgttataactcctgcttttttgcagaagttaaacgctactttgatgcggacaacagggggaaggcataatacaataggcggctctttcgattcttccagaggtgagttccgtttgtgtggcgttacgcctggtgtaggtgggcgttcttatatggattatcaaaaagtacctgttaaagtagaagaactttgtttcttgttgcaggaacggcaaaagaatgtggaaacgttccgtgaacaatacgaattaagttttaatgctcacctcaatttagtgactattcatccttgggtggatggcaacgggagagcagctcgcttattgatgaactatattcaattctgctatcatcttttccccgctaagatttttaaggaggatagggcagattatatcctttttttacaacaagcgcaagatgatgaaaccaaccagccttttttggatttcatggcggtgcaattgaaaaaatcactgtctttggaaattcaaaaatataaagcttctcacaataaaggatttagttttatgttttaatcttgtagggcttcttttgataagacttccacccattgtatattgtgttgtttttcattaacgaaatcaccattacagtaacggcggttgcatttattaatatcgaacttatgtaattctctaatagttttaaataaaggttcatcagtttcaccgttagctgaatagttatagaccagatatttatggtggaaggaaacgcaaaatatagaaatattcatccttcacactcttcaccgttcgtaagcgtctccgcgattctatcttgtcgcccttttttcattcttatatttttgctatgtataaaaatgaagcattatggatttagcataaagagaaattaacaaatgttaatccaccccccaagaattacaactgagccaatatattctctatatttgtgtagcatttgcattaaaagaacatagtatatcatggaaaatgaaaagaaattaacccgctcttccaatcgaatgattgcaggtgtatgtgccggaatagccgaatatttcggatgggatgctactttattgagaatagtatatatattggctacattcttcactgctttcgccggagtgattatatatattatcttgtggattgtcatgccgggaagaaaaccttcagacggatatgaagaccgcatgaatcaacgcctacattgatatgaaaatcaagaatatcgaccatatcgtcataccggtgtccgatatagataaaagcctacatttctacacagaagtcctgggaatggaagccgatacaagcaaccaacgctttgccgtcaagttcggtaatcagaaaatcaatcttcacgtaggaaaagcacagttccttcctgctgccaagcatcctgctttcggaagtgcggacatctgtctactgacagaaggaaacatagaggaaataaaagtcgaagtagaatccaaaggaatagaaatagaagtcggtatagtccagcgtcgaggtgcgcagggtgccatccggagtatttatttcagagatccggatggtaatctgatagaagtaagtacattaatataattccagcccgaactcatctttcagttgcatcaatgcctgattcttttgagccatcatctggaatttctcgacacgtcccacaggacgtactgtttctgttgcctcacttacccgcactgtcatcatcactttactgttcttcagtctgccgcgaagataatcctgcaattcgggaatcaaagctgtaaaatcctttgcagcaaactcattatcaaccaccacttcaaaagtagttgagttgttaagcaacgccggacggagcatctgcatacgttttgcaagagcatcctgttctttcggcaactggccggcatactcctgccaataataattcaaatcccggtcattgaacataaaatcctcttccggttgttgcaccttaggaacataagttgtagtcgcattctgcgatacttggtcacgctgcggattcttgatagatacccccaagctggacatcttcatcacgggaatttttcgttcttccttggcagtctgagcaactcccgctccttgtgacggagcagacgaagccgcaccaggagaagccggtgctcccggttgcacagccgcagaagcctgcggatgctgggcagtagtgccattagcagcctgtgttgtaactgaagacggagacgaatgaactggagcctgctgaacctgagtggcagaagctacctgcggctgctgtgctgcggcaggctgagtgaatacgggttttatagtcttcttagggccacgcccaccactcacgtcatccccctcggtggtaagctgtgcaacctgtatcaaggtcagttctaccagcaaacgcttatttttgctgatgcggtaattcaaatcgcactcattacacagcttcatagcccggtacaagaaaggtaacggacatttctgcgcctgttcctgataactttggcgtatgctcgctcccacttccagtaaaggcaatgtcaccgggtctttcccgaccaacaagtcacggaaatgagacgacaatccggtaataaagtgacttccgtcaaaacctttattcaatatatcattgaaaagcaacaatgcgtcgctcaccttgttttcgaggaagcaatccgtcagacggaaataatattcataatcaagtacgttcagattatcaatcacactcttataggtgatatttcctccggtgaaactaaccacctgatcgaagatagacaatgcatcacgcataccaccgtccgccttcatggctatcacgttcagcgcttccggctctgccgtgattccttctttcgaagcaacatacgacagatgattcaccgtatcttccacgcttatccggttaaagtcataaatctgacaacgtgaaagaatggtaggaagaatcttatgcttctccgtcgtagccagaataaaaatcgcatgacggggaggttcttccagcgttttcaggaacgcattgaaagcagatgccgagagcatgtgcacctcgtcgatgatatataccttatacttaccaatctgtggcgggatacgcacttgctccaccaactggcgaatgtcatccaccgagttattagaagcagcatcgagttcgtgaatattatatgaccgctgttcgttgaaagctacacatgactcacactgattgcaagcctctccgtcagcggtaggcgtcatacaattaatggttttggcaaagatacgcgcgcaagtcgtttttcctaccccgcgcggtccgcaaaacaaataagcatgagccagtttttgggtagcaattgcatttttcagcgtagtagtcaacgcccgctgccccaccaccgattcgaacgtggacggacggtatttacgggctgaaacaatatagttttccatatccgggattctctctgtttttgaaatttcgcttattctgcaaatgtacacaaaaaaagtgataagtaataagggataaagagagaagttttgaagccgaagcgataagtttttaagttattagttttatctttgcagatattaaaaggagaaattatgggtaaactaatcagtatctggagtttcatatgcagacgcaagtacctcattacggtcgttgcatttgctgttatcattggctttctggacgagaacagcctggttcgtcgtttcggatatgaacgggaaatcagccagttgaaagaagagatagaaaagtaccgggcagattacgaagagaacaccaaacgtctcaacgaaataagtaccaatccggacgccatcgaacagatcgcccgtgaaaagtatctgatgaagaaacccaacgaagatatttacgtttttgaagattaaagaatgaaacaattagtacccgcccttttcaccgcaggcgccataatggctctcaccggagcagctgtgtttattaccggatggatatacgctccttacatatatactgttggagccggatgtatcgcattggcacaagtgaacacacccgtcaaaggaaagagcaaaacattgaaacgcctgcgtgttcagcagatattcggtgcactggcacttatcctgaccggagccttcatgtttaccacacgaggcaatgaatggattgcctgcctcacagttgctgccatcctcgaactttacaccgctttccgtattccacaggaagaagaaaaagaaaggtcataaaaaagcccgttcatagcttttcagtcttgaacaggcatcactttttttaattcgataatgttccgtccttttataaagaacggaacagttttatatcatttatttcttcacaggtgaatatcttgcattcaacccgtcaacaatttcttttgtaatattgaaagtgctgtcagcataaagcagattatcgaaaccagtgttgctgaagatcaggctatatccgtgagtcttattatattctttcaggaaagcgttgatagaatcgcggaactgcaagctattcttgttgttctcttccatcaaaccattctgaagcttgttgctcaactcttgcaaatcttgttccaacttcaccagacggttgtactcttgctgcgctctatcttgtgacaggaaagcattgttttcaactttcttctgaaaatcttgcttttccttgttcaaagaggtagccttctgattcaatgtcatacgaacgttttcgctcttctttaccatcgcctcattcaagtcaatacagaaattgtatttggcaagcagcgtatctatttcaacataggcaattttcattcctgacagttcggcattagcctgagccggagcattggtagtttgattgtcagttttgccagcacattgtgaaaataaaacgataaacgcaagagcagccaaaccgttcatgaggtagttcattctattcataattaataagtattgtttttaataaatttaattcatactatcgttcaaggctttttccaactcgttaatagaaaaacgcggcttcttttgtgcttcgcgatcttgcgactgtgcgcatccgattcctttctgacgcaacgctttattcccactcacgtgaccattcgggaacttcccacccttcgtaaagaatactttcacccctaataataccagggaaatagcaactattaacaaagttatcagtatagtctcaaccatttctattaattttgtgagtgcaaagataggctttaatgagatatgagttcagataagtcaatcaaattaaccatatttagcaatagaagaagcgaaaacaacccttctattcctatgataaaatagaaacagcatggaaaaaaaagacttaaagccggctggcgtattcaagtatttcgaagaaatctgccaagtgccacgcccttcgaagaaggaagagaaaatgattgcctacctgaagacattcggagcaaaacataatctggaaaccaaggtggacgaagccggcaatgtattgattaaaaagcccgctactccgggaaaagaaaatcttcaaaccgtcgttctgcaatcgcatatcgacatggtgtgcgaaaagaataacgatgttcaacacgacttcctcaccgatcccatcgaaacggaaattgacggtgaatggctgaaagccaaaggcacaaccctcggagccgacaacggtatcggtgtagctaccgagctggctattctggctgacgacagcattgagcacggtccgctggaatgcctgtttaccgtagacgaagaaaccggactgaccggagcttttgccctgcaagaaggttttatgagcggtgacatccttctgaacctcgattcggaagatgaaggggaaatctttatcggatgtgccggaggtattgactccgttgcagaatttacttataaggaagtggaagttcccgccggatatttcttcttcaaggtggaagtgaaagggttgaaaggcggtcactccggtggcgacattcacctgggacgtggcaatgccaacaaaattctgaaccgtttcctttcacgcatggctgccagacacgatctgtacctatgtgaaatcaacggtggtaacctgcgcaacgctattccccgcgaggcttatgccatctgtgctgttcccgaagacgccaagcatgatgtccgcaccgaactgaatattttcaccagcgaaatggaagacgaattatccgttgtagagcctgacttaaagctggttctcgaatcggaaactccacgcaaaatggctatcgaccaggatactactacccgtttattaaaagctctgtatgcagctcctcacggtgtatatgccatgagtcaggatattcccggactggtggaaacttctaccaatctggcatctgtcaagatgaagcccaaccatatcatccgcattgaaaccagtcagagaagttctatactgtccgcacgcaacgatatggcgaacacggttcgcgccgtattccaactggcaggagccaatgttactttcggagaaggttatccgggatggaaaccgaatccacattcggccatcctcgaagtagcagttgaatcatacaaacgcttatttggtgtagatgcgaaagttaaagccatccatgcaggattggaatgtggtctgttccttgataaatatccaacgctggatatgatctctttcggaccgacactgacaggtgttcattctcctgacgaacgaatgcttattcctactgtagaaaagttctggaaacacctgttggacatcctggcacatgtacctgccaagaagtagcgggcaaataagtcaacataaagaagagtatggtaacagtcaaaaaagaatagctgttatcgtactcttttttactatgattttatcaggtgtaagtttcctcgctccttccaatatcattgcacaagaggttcacggcagacaagcctcctctcaacaagaaagaatctctttccgtgttgtaagttggaacatagaaaacctgttcgacacacaccacgacagtctgaagaacgatcatgaatatcttcccgatgcgatacgtcattggaattatagcagatataagaaaaaactggctgatgttgcccgtgtaattactgctattggcgaatggaatcctcccgcattagttggattatgtgaagtagaaaatgatacagtgcttcgtgaccttacccgtcgttctcctttaaaagagctcagctatcgttatgtaatgaccaactcccctgatttaagaggaattgacgtagccttgctttatcaacgggatctattcaaactattatcttcccgttccatctccattcctccgtttaagcagcaccgtccgacaagagatttgctacacgtcagcgggcttctactggcgggagatacactcgacgtatttgtctgccacttccccagccgttcgggtggagccaaagaatcggaaccttatcgtttatatgtagctcacatactgcgtacggaagtcgatagcattatgaatattcgttctcatccgcaagccattatcatgggggatttcaacgattacccgacgaatcagtccattctgaaaatactgaaagccgaagcgcctcctgttaaaaccaatgacctagcttcaacaaccgactccgccaacgcctcaacagttaccccctcctcactaaaactatatcatctacttgcccgaaaagcaaaatcaaaaaacttcggttcttacaaatttcgtggtgaatggggattactcgaccacttgattgtatcaggcacgctattaaatcaatcaaatcactttttcactagcgaagaaaaagcaaatgtatgccttctcccttttttactgaaagacgacgaaaaatatggtgacaaagaacctttccgcacttataagggaatgaaatatcaaggaggcatcagtgaccatcttcctatctacacagactttgaattgattgtatattaattatggcaaacgatagtagccaatattatcaggttattacaaataaagatagtcaaccattatcagagaagtacaaacgccgctacagcatactctgacaagagactattctcatcgtagtgagaatacttgagaaatataacgcctcatcatagcttcataaattaaattatcaaacaagagttccgaacttctatttctccatgtcctctatgatgcaaatgatgaattagtccgaatactgataaaccttcaaatcgaacttcggaaccattgccagcaaatggtcgaagatatccgactgaatacgctcgtattctttccagaccttattgcgggagaagaaataaacctgaataggtactccgtacatcgtagcttctttctgactgataatcaaatccaactcctgattgaccacaggcagactacacaaatagcgttcaatatataccctgtacacttgagaattggtaggaacgactccttcttccggctgataatccgccattaatggaatttctttccggtaacggtccaacatttccggagtacagaattgaagtgtagtcaaatccaaagttatactcttcatcacccgtcgtcctcccgactgtgtcattccccgccaattctgaaaaggactgctcactaatgtataaggaggaatagtggaaatggtattatcaaaattctggatcttgactgtattcagcgttatttcctgtacaatgccatttgcgtcaccggaaggaagcgtcacccagtcccccggacgaaccatatcgttggcagaaagctggatacccgccacaaaacctaatatggaatctttgaatactaacattaaaatagccgctgaagcgcccaagcccgcaaacaaagtagccggagacttattcacgataatagcaatgattacaatcccgccaacaaagaaaagaagcacctgcaacacttggataaaacctttcatcgggcggtctttcatcgactctcttccgtcatagatatccattatcatcaacagaatcccatttatagccaatagtaaagagaaaataatataaatgacgcacgccttctgggaaatcagcaacagctcttttccacggataaaagccatcggcaacaacgaataaaccagaaaagccgggatggtatgaatcaaattatgaaataccctacgcttcatcaacaatgtattccattgatgaggtttacgtctcgtatactgtttcatacctccaataagaattgcctggcaaagataattcaaaacgatagcaaccactatcatcagtaaagccataatagtctcatcaaaacgatcggcaacagccggatctattccccaattaatgagggttttattcatccattttcctaaatctactactaacataacttctgtctttttttataaataacagtaaaatattcatttggtttagaaaaaaagagactagtatccgatttatcaagaatcaagacaccggtctccactgctactctctaagcatatcatttttcgatgagggctccatcagggaatcaccatcacccctatttcattcatatttactttagcaacggtagcatcaggtgtagtggcctccagtttaatgaaacgtgcctgtactttctgactgaaagcaaccgtctgtggcaacggattatgcataatattgctgaactctccactggcaggcacttctttccagctcttaccatccatgcttacaaagaattgataacggaatgccatcgtcggctttgcctccgcttttgaaggcgcgtacgtgaaactgctcaatgttaccgtcttccccaaatcaatcgttaatggagaagcagcaacctgtttccatccggaacgcggcaaattattccagtcttctttcgttgtttcttcctgcaaaggttctgcataataagcggcaacctgactaacgtaagcagtcaaccggcactcgtctattctcacccggagcttattggcattaactgccggaaagcgcaacatacgtttatatcctatcgtcgtaccttttcctacttctttccagccattatccgtcaaggcttccacagtaaaagcctctaccctctgccctttcgttatatcttcctgcaacatgaccagattgatttccgatttggacttcaaggcatagacagcctcaccgcccgaagtagtgctccagtattttcttccgtttttcacccggttgtcagcaaacgtttgttgccgataatcagcaaactctttcaaccgcttgatatcagcttcatgaatcagtcccctccggtcaggtggaatattcaacaggagcactgaattatatcctaccgactggaaataaatatctgataaatgcttcaaagatttcactttaccatcttcctccgcatgatagaaccatcccggacggatagatacgtcgacttccgaaggataccagaataattccgtagctttctccaatatcttacgacttcccaaatcctctgctttactgaaaacacccaaacgtttgttgttctcttgtgaacgggcatatataccgggagtcaacacagttgcgttccattccgtttcacggcctactcctttctcgtttccgacccagcggacatcatcccccataattgccatcacagctttgggttggaggcgttggatggtttggtaaaaagcgtcccagtcatacacttgcttctttccgttcggaccttctccattcgccccgtcgaaccagacttcatgtacttcaccataattggtgagcaattccgtcaattgccgaataaaaaaatcattgtaacggggagagtctccataacattccgcattccggtcccagggagaaagatatactccgaacttcatatcatatttgtcacaggcagcacgaagttctttcactacatcgccttgtccgtttttccagggagaagaggccacggaatgtttggtagtagccgttggccaaaggcagaaaccgtcgtgatgttttgcagtcagaagcaccattttaaagccggcttccttgagggtacgtacccattgttcagcatccagttccgaaggattaaagagcgcgggatcttctttcccgtccccccattcacgtccggtaaaggtgttgataccaaaatgaaggaaagctgttaattccatttgttgccaagcgtattgctgtggagtaggtaccagacgcgctgccatatcaaccttctgttcgatagttgcactttgaggaaattcaacatgcttcacatagtaattttcttttttctgcgcctgcgctccactcatgagagtaacagacaataaaagagaggttagtagtttattcatggtctattaattattgcaatcgtacaaagataaaataaaggtgcagatttcacgatcctcatggaatattttcttacgacattccatccaatcagtgtaacccccacctttatatataatctaaataacctattgatttagtatctatttcaccggataaagggtaaattcaaaactctgtttctttaatggaaccaagtattgcggtaatactccgggaccacaagtagccgttcccacacctgcctgttcagcatccagatgcactgtcaacaatccatcgcgttccagttcattgatatggcgggccttctctaataatacatccgagaaaggaatgatactaaactggaaagcacgatccgactcaacaaagataccttcgccggaagtatctgccaacttcacccaacgtacatcggtgcggttgcctgtagattgcggagcaacataatagtggaacatccgttccggtgtggtctgatatacaccgattttaccggactgattgcggtcaatataggtttcattatctccacgtcccaagtaagaaacctgatcgtaggcgttcgacacacggaacgtc
